United States Patent 7,196,245 (POLYNUCLEOTIDES AND POLYPEPTIDES THAT CONFER INCREASED BIOMASS AND TOLERANCE TO COLD, WATER DEPRIVATION AND LOW NITROGEN TO PLANTS) - sequence listing, part 2

SEQ ID NO: 2032 - DNA, 969 bp, Lycopersicon esculentum
taaaaactctctatttcttttctttttttctcttttcacttataacaacaatcttgatccattaaaaaaaaaggatataatttgaatttaaatttgaattcaaatgaagattcaatgtgatgtgtgtaacaagaaggaagctatcgttttttgtacagcggatgaggctgctctttgtgatgattgtgatcatcgtgtccatcatgttaacaaacttgctagcaaacatcaacgtttttctcttgttcaaccttctcctaaacaagctcctatgtgtgacatctgtcaggaaaggaggggtttcttgttttgtcaacaagacagggctattatgtgtagagagtgtgatattccaatacacaaagcaaatgaacacactcaaaaacacaataggtaccttcttactggtataaaactctcagcaaactctgctctctactctgctccatcacaatcacaatcacaatcacaatcagcaatctcctccgcggattcgtgtgtttcaaatttgaagtctaaggattccactagtaagcctgttgctggttctgtgtttgtttctcccgcgattattagcaacagtactaagggaggagcagtatcatccgctgtggaatcagtgaaagttgttaaagagaaagttggtggatgtaataataatgtgcaatttgtgaatggagggggaaataacttaacaagtagtatatcagagtatttagagatgttgcctggttggcatgttgaagattttcttgattgttcaactcctaatgtttactccaagaatattggtgatgaggatatgttgtcattttgggatactgatcttgagagtcaatttagttcatttccaccacaaaatgttggtatttgggtcccctcagcccctcctctttcagagtcaaagcaagagactcagatccaatttttcccttcacaaaatttgaactttggtgggcaaattggtct

SEQ ID NO: 2033 - DNA, 548 bp, Lycopersicon esculentum
cagcagcagcatcaacaacaccaaataatgggacaaatttcactagtactgaaacaacaacaacaacgactatgaagataaaggtacaacaacaaaagcacaaaataacaaaagtgaatgccaatcatgttgtacccttcaagaaaaggtgcaaatttttaagtagtactactactcctgcacctgaacctggacttgtacctacacctgctcctcgtgttggttcatcatcatcgtcatcattttataataataataacaacgacgtgcaacaaaagaagaagatctgtttcgaagatttctttatgaatttgagcaataacttggcaatccatcgcgttttccctcaggatgagaaggaagcagcaattttgttaatggcattatctagtgaccttgttcatggttaatggcattataaaattttcttgagtttctattattagtttaagttattaattagatggagtagcaccaaattagttgtgtgaaactgagctagaattaatactagtgagagtgagagtttttataagtcaagctacaaa

SEQ ID NO: 2034 - DNA, 614 bp, Lycopersicon esculentum
cggccatcaactccgggagctgcaccatcttcctcaccttttcgcccttcaaatgataatttggatgctcatacaaatgcattgtctgaccaggaattacagttgaaaactcgaagagaaatcatggcacttggaactaaacttggcaaaatgaatatagctgcctgggctagcaaagatggtgaggatagaaatgcatccagcttgctgaaaactgataagcaagaccaaccaaataccactggtactgagacactcgcagctgcttgggaggatgcagagaaagcgaagcacttagcctggtttaaacgagaagacatcaagatacaagcatgggaaaatcatcaacaagcaaagacagaagccgagatgaggaaaactgaggcggaggtggaaaagatgaaggcacgagcacaagacaagctaatgaacaagatagctgcggttaggtacaaagctgaagagaaactggcagcagcagaagccaggagaaacaaacatgctgtaaaaatagagaagcaagcagaatgcattcgtaaaactggtcgattaccacactcattctcctgctgccgctggtgcttctgaagagcttcaaatcactatctaatgcg

SEQ ID NO: 2035 - DNA, 503 bp, Lycopersicon esculentum
ttttgtccatttggatgttgacaagattcatcactacaatttcactcttttctcagagatactgtcacacccacaagcttgaaatcatcctttatggagtatgaaagaatcgacaagagaaatttacagctgtctcctagaaaactgaggtctatgctactgggagcagaaaagaagaggaaacaagaagggaaggatgacgtagtagaagatcaagagcttgaatctgctactgtgtccttgagatcccatttgcctgagatccatgaatccggttgtaatttggagaattacaaagatgtaaatgttgtaagtgttgttcctgagagttcgacttccttagcacttgattcatcaatgtcattggagatgattaatgacacgagaatcaaagatcaatctttggttagtacaagaattacgtctcaagatgacagtagtttggactgtgatggtggaatcgatagtgttggtactgtatctactctctttgaatttcaaaa

SEQ ID NO: 2036 - DNA, 520 bp, Lycopersicon esculentum
caaaatttactcttcttattgccatgattcccaattacacaaattcttcttcttcttcttcatttccttttgaacttactaatgaagttcatcatgattatctaagtcataataataataatatgtctcttgttagcccttataataataactatcaattcgcttcatcatctacaaattcatcttgtcaaaatttcttcaatatttcaactactactaatattcaagatcaaagtggatatgattatcaatttcatcagccacaacaccatcatgaggttgataattttgcttcaagatcaagtggatcacatgatcatgtagacaagaaaaacaagggactcaaattaaccttatggaaaaaaggggggcaaaaagtgaagaatttgaaagtagaagatcaaaagcaacaaatcatagaaactgattatagcagcaacagctcttccaacaacaatatcatcccaattagggtttgttctgattgcaacactactaaaacccctctttggagaagtgg

SEQ ID NO: 2037 - DNA, 159 bp, Lycopersicon esculentum
cttataataataataataataactatatcataccctcatcaacaaattttcaatatttacaaccaccaccttctcctcctctgaaagaacctcttcctctacttagtttaagtcctattcatcaacatcaaggtaattattattcatctactatggaag

SEQ ID NO: 2038 - DNA, 1596 bp, Lycopersicon esculentum
ggttttgttgatgccaaagtcaagaacaaatattattgaacctaatttttaggttcaaacaacttaattttgcctctatataaaagagtcaacaagcataacatgtccattgtaacttgtgaagaagctgctgcaagtttatcttcttcttccaacatgaataatgatactaatggagccttttgctatccacctcaacatcaattagttactcaacaaatcaagaaaaagagaaaccaaccaggcaatccagatccagaagcagaagtgatagctttatcacccaagacactagtggcaaccaacagattcttttgtgaaatttgtaacaaagggtttcaaagagatcaaaatctacaactccatagaagaggacacaatttgccatggaagttaaagaagagagaaaataaagaagtagtgaggaagaaagtgtatatttgtccagagtcgagctgtgtgcaccatgatccgtctagggcattaggagatcttactggaattaagaagcattttagcagaaaacatggtgagaagaagtggaaatgtgagaaatgttcaaagcgttatgctgttcaatctgattgcaaagctcacttcaagacttgtggtactagagaatacaaatgtgaatgtggtactattttctcaagacgagatagtttcatcacacacagagcattctgcgagactttagctatggagagcgcaagatcagtaataaatgaacgaaatccaacaattttctcacctcaaatgaatctccagtttcaacagcctcactactttaatagccatgaacagattcaagctgctacgtttcccatgaaaaaagagcagcaaagtagcgatttcagacatattgagattcctccatggctaattaccacgaattcacaaccatttcagcttggagctattaatcctagtccttcagtaccgctcagtaattttagctcatcgtcaatttttccagctactactaggttagatcaacaatacagtcaaagcagccacaaagatttaaatcttcatcatcagaacccaaaccctaatctcagaggacctacattaggttacgattcaatgggagaatcaggtgtggtctctccagtacacatttctgcaactgcattgctgcagaaagcagcccagtttggtgctacaattagtaacaaagcaagtgctgtcactgctactgctgcttacacaggcacagcaaaaataccccacaatactcacgtgtctgttactagtactgattctgctaccaaacaaactcagcagaaattgtcctcacgtgaagacctgaccactattactgggcctgcaaataatataagtggcatcatgacatctttttctaatggctttgatgggtcaacaatgtttgaagatgcgatattattcggtggattcaacaatttgaattcaaaaaaggagaacgaggacgaagatcaacaactctacttcaatggaagtatgaatgaggaggatcatatattaaccaaagatttcttgggtttaaaacctctctctcacactgatgacattttcaacattgctgctcttgttaatactgaatttaaaaatcat

SEQ ID NO: 2039 - DNA, 1292 bp, Lycopersicon esculentum
ggaactattaattattactctttgctggcctctttcttcttttaccttttgtcatctctagggtttcagacaaagcagccaaatatattttttatatatatatatatataaacaacaaactacatctcttacttacaccaactactctacttttgcttttattttttatgagagaatgataaaaggtatgctaggagatgatagtatgtcaaatttaacaagtgcatctaatgaagcaagcatatcttcaaccaacaatagaattgaaattggtagtcatgttctctacccacaactacaaaacattcaaacccaaccacctcctaacaagaagaagagaaatctaccaggaaatccagatccagaagcagaagttgtagcattatctccaagaagtctattggcaaccaatagatttgtatgtgagatatgtaacaaaggatttcaaagagatcaaaatcttcaactacatagaagaggacataatttgccctggaaattaaagcaaagaagcaataaagaagtgaagaagaaagtatatgtgtgtccagaagcatcatgtgtacatcatcatccatcaagagccttaggggatctgactgggattaagaagcatttctgtagaaaacatggtgagaaaaaatggaaatgtgaaaaatgttcaaaacgttatgcagttcaatctgattggaaagctcactctaagatttgtggtacaagagagtatagatgtgattgtggaacccttttctctaggagggatagtttcattacacacagagccttttgtgatgctttaacagaagaaagttcaagaacaataatcccaccaccaaattcttcaacttctcatcatcttaatcttcatacacttcaaaacttccaaatgaaacaagaacagcaacaacaaaataacgacctctcctctcagttattcattcaaaaccctaatggcaatagtagtaacatgttcggtgcaccacctcctcatatgagcgcaactgcattgctacaaaaagcagcacaaattggagtaacttcttcttctcatactgctaataacatgagcgccacaacttttttcagtcctactaccagtacaacaactggcattgcaatgtcaggatcaggatcaggagcaggagtagcacgtcaatatcatccatttgaaaataataataataataataatacaaacactgattttgttactggtaatacgtcttttcctgattttggtgcgagtgtcacccctgggttcatggaacaagtccatgacatgcaaaacatga

SEQ ID NO: 2040 - DNA, 702 bp, Lycopersicon esculentum
ggaaaaaacaagatttgtttgttgggttgatgccaaaggaagaagaaaccacaagactggagagttggtagattagcttgaagagggagacgaaagagatcaagattatgatgatgaaagatttaatgaatcaacaagctcaagtacctggtgttgttatggaggagaacatgtccaatttaacttctgcatctggtgaagcaagtgtatcttcttcgaaccgaaatgataataataataataataataataatatttatcctcatcatcagtataactttgctcctccaaatcaacaaactcaacctgcacaacaaatcaagaagaagagaaatcaaccaggcaatccagacccagaagctgaagtgatagctttgtcaccaaagacactaatggcaaccaatagatttgtttgtgaaatctgtaacaaaggatttcaaagagatcagaacctgcagcttcacagaagaggacacaacttgccatggaagctcaagcaaagaacaagcaaagaaataagaaaaaaagtgtatgtttgcccagaaactagctgtgttcatcatgacccagcaagagctctgggagatctcactggaatcaaaaaacacttctgtagaaaacatggagagaagaagtggaaatgtgagaaatgttcaaagcgttatgcagttcaatctgactggaaagctcactccaaaactt

SEQ ID NO: 2041 - DNA, 400 bp, Lycopersicon esculentum
  misc_feature (308)..(308): n is a, c, g, or t
  misc_feature (316)..(316): n is a, c, g, or t
acggtcaaacaacttaattttgcctctatataaaagagtcaacaagcataacatgaataatgatactaatggagccttttgctatccacctcaacatcaattagttactcaacaaatcacgaaaaagagaaaccaaccaggcgatccagatccagaagcagaagtgatagctttatcacccaagacactagtggcaaccaacagattcttttgtgaaatatgtaacaaagggtttcaaagagatcaaaatctacaactccatagaagaggacacaatttgccatggaagttaaagaagagagaaaatnaagaagtngtgaggaagaaagtgtatatttgtccacagtcgagctgtgtgcaccatgatccgtctaaggcattatgagatcttactggaatt

SEQ ID NO: 2042 - DNA, 652 bp, Lycopersicon esculentum
gaatcagttggtagattagcttgaagagggagacgaaagagatcaagattgtgatgatgaaagatttaatgaatcaacaagctcaagtacctggtgttgttatggaggagaacatgtccaatttaacttctgcatctggtgaagcaagtgtatcttcttcgaaccgaaatgataataataataataataataataatatttatcctcatcatcagtataactttgctcctccaaatcaacaaactcaacctgcacaacaaatcaagaagaagagaaatcaaccaggcaatccaggtttgaattcaaagctttttgaagtacttttgttatatgcttttttttgggttatgaaatcctttcaactttttcttttcccctttttgggaccaatcatgtggtaacagacccagaagctgaagtgatagctttgtcaccaaagacactaatggcaaccaatagatttgtttgtgaaatctgtaacaaaggatttcaaagagatcagaacctgcagcttcacagaagaggacacaacttgccatggaagctcaagcaaagaacaagcaaagaaataagaaaaaaagtgtatgtttgcccagaaactagctgtgttcatcatgacccagcaagagctctgggagatctcactggaatc

SEQ ID NO: 2043 - DNA, 569 bp, Lycopersicon esculentum
gctctcaactaacattatatccacattcatgtttgaagtaaaacatcatggcttgtatagatcaagaacaacaacaacaacaaccaatttataagcattattgtagagtttgcaagaaaggttttgtgtgtggaagagctttaggtggacatatgagagctcatggaattggagatgaaggtgcaaacatagatgatgatgatccagctagtgattgggaagataagtttggagggggtgttaagggaggtaataagaggttatatcaattaagaacaaaccctaatagacaaaaaagcaatagagtttgtgagaattgtgggaaagaattctcatcttggaaatcatttcttgaacatggaaaatgtagctcagaagacgcggaatccctagtgtcctcgccctgtttagagggcgaggactacattaataatggtggaagaaaaggctatggatggtctaaaaggaaaaggtcattaagaacaaaaattggaaccattaatagtactacttcaacttatccatcaagtgaagatgaagatcttgtccttgcaaaatgtcttattgat

SEQ ID NO: 2044 - DNA, 542 bp, Lycopersicon esculentum
tgaagaagttgatatgattatactaaatacaaaaagtagatcataacaagaaattatatcataaactatagttatacatttaagtataaaaaactttatcaaatattttttatttcacaattcttattaaatctaaaaatcataatttaactaacaatataatcatatcattcaattaattttctctcttctatatcactttcaaataactttgaacttatttaccatagataaggaaccattttgttatttttttattttttttttaatttatatatacatgatacatccttttaaattttttaaatatttttttttaacaagacaaagtgatttatacaaacttctaaagtattgctattttctagggctgaagaaattggagaaaaagtttgtgtttggtgttatggaagatgaagatttgttaggttgtaacagtgagaagaaaaatggagaaataattgagaaaactaaaattagtaatagtaatggtgtagagatttaagagctacagctttaactatggtttctgggtttagatt

SEQ ID NO: 2045 - DNA, 625 bp, Lycopersicon esculentum
ctcattcctcttcctcctatatcttttctctccgccccattttcactatcacaaatcaaagcttccaaaatttagaaattgtatacaaaaatggaacttctgtcctctaaactctgtgagctttgcaatgatcaagctgctctgttttgtccatctgattcagcttttctctgttttcactgtgatgctaaagttcatcaggctaatttccttgttgctcgccaccttcgtcttactctttgctctcactgtaactcccttacgaaaaaacgtttttccccttgttcaccgccgcctcctgctctttgtccttcctgttcccggaattcgtctggtgattccgatctccgttctgtttcaacgacgtcgtcgtcgtcttcgtcgacttgtgtttccagcacgcagtccagtgctattactcaaaaaattaacataatctcttcaaatcgaaagcaatttccggacagcgactctaacggtgaagtcaattctggcagatgtaatttagtacgatccagaagtgtgaaattgcgagatccaagagcggcgacttgtgtgttcatgcattggtgcacaaagcttcaaatgaaccgcgaggaacgtgtggtgcaaacggcttgtagtg

SEQ ID NO: 2046 - DNA, 1373 bp, Lycopersicon esculentum
gcacaagcaggatgatgatggccttgatactttgtccattcctgtttcttccagagcaccctcatcatcaggaggaggggaaggaaatgtctgggcattgatacctgatctaggaaataaattacgggtacaccaaaagagagcctttgagtttctgtggaaaaatattgctggatccatagtacctgcagaaatgcaaccagagagcaaagagagaggtggctgtgttatttctcatactccaggagctgggaaaaccttacttattatttccttccttgtaagctacctgaagttatttcctgggtcacgaccgttggtccttgctcccaagacaacactctacacctggtacaaagaagtactgaagtggaagattcctgtgccagtctaccaaattcatggtggtcaaacctttaagggagaggttctaagggaaaaggtgaaattatgtcctggtcttcctcgcaaccaagatgtcatgcatgtcttggactgccttgagaaaatgcagatgtggctttcgcaaccaagtgttctcctcatgggttacacctctttcttaacactgacacgggaagattcaccttatgcgcataggaaatatatggctcaggtgttgcggcagtgtccagggctactaatacttgatgaagggcacaacccaagaagtacaaaatcccggttaagaaagggtctaatgaaggtcaatacacggcttaggattttactttctggtacattatttcagaataattttggagagtatttcaatacacttaccttagcaaggccaacttttgttgatgaggtcttgaaggagcttgatcccaagtacaagaacaaaaacaaaggtgcatcgcgcttttcattggaaaatcgagcaagaaagatgtttattgataaaatttcaactgtcattgattcagacatccccaagaaaaggaaagaaggcctaaacatattgaagaaactaacaggtggattcatagatgtgcatgatggtggaacatctgataaccttcctggtttacaatgttacaccttgatgatgaaatcaactactcttcaacaagagatcttggtgaagcttcaaaatcaaaggcccatctataaaggatttcctctggagttagagctgttgattacccttggtgcaatccatccttggttgatcagaacgacagcatgttctagccagtacttcaaggaagaggagctggaggctctccagaaattcaagtttgatctgaagctgggttcgaaagtcaaatttgtgatgagcctaattcctcgttgtctcctcaggagagaaaaggttttgatattttgccacaatattgctccaattaatctttttctggagatatttg

SEQ ID NO: 2047 - DNA, 450 bp, Lycopersicon esculentum
aaaattctcctctgacctgacatggttaatgactgcatctgtcctgaaagaagctacatttgatgtgagatcgatacataaccagattgtctatgagattgtggatgatgatctagtcagaaaagaaacaaattctaaccaacattcttactcagtgaatttcaagttagaaggcggagttcaaacaaccactgctattcaattcaatagggatatcccagatataaattctaccagtgaccttagtgaatccgggcctctagttctgtatgatctaatgggcccacgaaggtcaaagcgtcgatttgtacagccagagcgttattatggatgtgatgatgatatggcagaatttgatgttgagatgacaaggttagttgggggtaggagaaaagtggagtatgaagaactaccacttgcactttctattcaggctgatcatgcttatcg

SEQ ID NO: 2048 - DNA, 975 bp, Lycopersicon esculentum
gagagagagaactagtctcgactttcaccaccacattcaagaacttgcagcagtaatccaaatcccaatttctccaaagaactcaaaatcccagaaaaaagataaaacacaatgaaagctgtgaagggtcatcaagaagaggaagaagaggaggaagatgagactggtattgttaagaaggatgccacaccttctagcagtaataccaaagatgggaagagtaatgagaaggctagtgccctaaggtctaaacattcagtgactgagcagcgtcgaaggagcaagatcaatgagagatttcagatattgagagatctgataccccatactgatcaaaagcgagacactgcatcattcttgttggaggtaattcagtacgtacagtatttacaggagaaggtacagaagtatgaaggaccatatcagccttggagctcagagcctacaaagcttatgccatggagaaacagtcattggcgcatgcaaagtttacctgcacagccacatgccttgaagaatggtagtggcccagaatcaacatacctgggaaggtttgatgaaaatctcgctactgttacttctacgatgcaaccaaatcagcagaatccaattgaatctcatactagcagggatgtatcatttaaagcacttgatcaacaaaatgaactagctaacaagtcaatcacaacacccattcctcttcaggccggtatgaagatgtcagtgccaaacaatagtgctttctcagagcctcaacccagaccagtgtctgatcaatgtcctaacacaattgatgctctgaatcatgacgaggatgacgtaatagatggaggcagaatcagcctttcaagttcatactcgcaggggtttctaacttcgttgtcgcaagcgctgcagagtactggtctagatctttcaaaggctactatctcagtgcagattgattttgggaagcgcgcaaaccaagcaatgacc

SEQ ID NO: 2049 - DNA, 544 bp, Lycopersicon esculentum
gccaataattagctatacaactcacatttctctgtagtatataagttttgcaagtgttgttaataatcggagccttttagcgaaatcgccagtctctctgtttaatcttcttttgttaacagctaataagttgttatttcgactgaattttgttagctggtttcagattttgaaatggtgaggactgtgaagaatcatcatgaagaggacgaagaagacgatgaagagttttcatctagaactcccgatggctcttctcaaaaggggaaattagaagggaagagcaatgatgggaaggtaagtgctcatcgttcgaagcattctgagacagaacagcggaggaggatcaagattaatgagagatttcagactctaagagatctcataccacaaaatgatcagaagagagaccgagcgtcattcatgttagaggttatacaatatatccagtttttgcaagagaaattacagatgtatgagggaaccaaccaaggatggagtgcagaaccctcgaagttgctgccatggagaagtactcctgggc

SEQ ID NO: 2050 - DNA, 520 bp, Lycopersicon esculentum
aaataaaatcttaaaatcttgaaaaaataagatgaaatctggaaagggtcatcatgtggaagaagaagaggatgagtatgattttggttctaatagagatgccacaccttcaagtaatagtactaaagatgggaagaacagtgacaaggcaaatgcaattaggtcgaagcattcagtaactgagcagcgccggaggagcaagatcaatgagagatttcagatgttgagaaatttgataccccatactgatcaaaaacgagataccgcgtcattcttgttcgaggtaattcagtacgtacagtatttacaggatacagtacagaagtatgaaggatcatatcaaccttggagctcggagcctacaaaacttatgccatggagaaacactcagtggcgcgcgcagagttttcctgcaaaccctcaagccttgaacaatggtactgacgctggaccaacatattcaggaaggtttgatgagaatctcttaaccgtcacttcgtcaatgcaagccaatcagcgg

SEQ ID NO: 2051 - DNA, 780 bp, Lycopersicon esculentum
taagccgacaacagttcctatgcacccaaacacgttttcattttctgggactagtagcacggcagcgctttattcatcaaagctgatagctgatactgataagttggagtcaaagtctcattctcaattttcacttagcagatcgcatatgactgattatgctattccaaatgctaatccagaaaggctggagctgcctatagaaagtggtaccatcagcatctctagtgcctattctcaagggctattgaacaccttgacacaagcgctgcatagttctggagtagatttgacccaagccaatatctctgtgcaaattgatcttggaaagagagcaaatgggagagtaaattcatcagcttccactgttaagggtgacaacgtttcaacaagcaatcaaccaattccaaaatctagagttacaaccacaagggaggagcctgatcacgccttcaaaaggcggaaaacaagctaatgctaatttgaaacactagtgttctttcttcttttttttccattggttaaatttaattgttttcctctttcccttccccttctcaaccaatatcgatgtccacacctgatacagaaaatctcccaaatgagagatcacaagccactgtatatgtaatgaactagtactactactatttttctgccccttcaaattgttgggctgcacaaatttacctgactagagtgtgatattttattacttgggtagtaaactactgtattaatttattactaaggctttcaatgatgatgatgagacagctg

SEQ ID NO: 2052 - DNA, 1252 bp, Lycopersicon esculentum
  misc_feature (1088)..(1088): n is a, c, g, or t
  misc_feature (1206)..(1206): n is a, c, g, or t
  misc_feature (1210)..(1210): n is a, c, g, or t
  misc_feature (1212)..(1212): n is a, c, g, or t
ttatagcaagtcagagtatccactttctcattatgcaaaaatgtttggactgcaagctgcagtagctatacgtctacgtagtatctcaactggttcatctgattttgttttggagttctttctaccctcagactgcagaaatcctgaagaccatagaaaaatgcttacttcattatccatcatcatacaaaatgtttgccggacattgagggttgtgacagataaagagttgcaggaagaaactatatctgtgggagaaatggcaaaccacacagttgaacaacataaggagcacactgaaacctctcaagaaaggacatcgtggacctcttgtgacgcagagttccaggagagttctgttatgtctacattccaggatgaaaaaccagatgaaatgctaaggaaagattcggtggagtttaggcaccgtaagaattctgcttatgaggagggtgtctctcgtaatctgggtaaaacgggagacaggagacgtgcgaaggctgagaagactattaccttgcaagttcttcagcagtattttgctggtagcctaaaagatgctgcaaagagcattggtgtttgtcctaccactctgaagaggatatgcaggcagcacggaattaaacgctggccttctcgaaagatcaagaaggttggtcactccttacaaaaaatccaacgtgttattgattcagttcagggtgcctctggcactttacaaattgaatccttctattcaaacttcccagagttggcgtctccgaatgcatcaagaatgagcccttttgcagactcaaagtcaaatgaacatccaacagccttgaacacacaacaagagagatgcattacgagccccaatcctgatgcatctaagtcaccctcttcttccagcagtcgaagttcaagttcaagtcaatgttgttcatccgggacaaaacctcaatcgcctcaatctcaccctttgagtattgttggcgatgaagatctaatcgtacaggaagagtctgtagataatgcagtgaaaagggttaaaagtgaaccagagcttcatttatcaagtgaagcactgaagactataccaagatctncaaagccatttatgtgttgctgagaatcctatatcagaaaaccttgtattgaaggaggagtccatcaacatctcaagaagaagctccacgagtaaaagtaacacatggagaagaaaanattnangttccgaatgcaaaacagttggagataccatgatcttcta

SEQ ID NO: 2053 - DNA, 456 bp, Lycopersicon esculentum
cggtttggcatagatgatcctagtggacttcaactcaagtaccttggacgatgactccgagtgggttctattaacatgcgatgcagacttggaagaatgcatcgatgtttgtatgtcttcccaaatccaaatgatcaagctcatcttagttcaagattcacagcatcattttggaagctctttcggtagcagcagtcctatattagtacagtaaccaactggtataccccctagttgccaaaatggatatagttcccttttaggattagatttggtatgagacttgaagaaatgttgcttgcttaattgtaaattcattctgtttgagtcttcatgtaagtcaatccttttgactgatatgaactagtattgagccgtaaggctattattgtttcatctagagtactcaaaactcattatagtttcaaagtttaataatttgttgaaattttagtt

SEQ ID NO: 2054 - DNA, 593 bp, Lycopersicon esculentum
tccgaaaattgtacatctatggctaataattctactcccaccgacgcttctagcaagaaggtacggaaaccatacaccataaccaaatctagagaaagctggactgaagaagaacacgacaagtttctcgaagctcttcaactgtttgaccgtgattggaagaaaattgaggatttcgtaggctcaaagacagtaattcaggtacatttgtaaagctttgcttacaactttaagctctttggagttaattgttggtgtgtgacatgcattcaaacgtacctggtatataatctagagccgacttattcaatgggaatttatttggccatgtgttaatgtgcgcgatcttttgtattctattaggccctttttcattattcaatttggagaaacttgtcatgaattcctttcgttctgttttggttcagagcacttggcatagcataacgatgtatagagtatgctatgtatgtatacatggaaaatctgtttatatggaacatttgccctaatattatcggttacagattcgcagtcatgcacaaaaatacttcttgaaggtccagaagaatggttcaatagcacacgtgcca

SEQ ID NO: 2055 - DNA, 480 bp, Lycopersicon esculentum
gaaacaacccagcgctcattttcacttctccatcacaacctaacaccgccgccgccgccgccaccaccggagtacccacacaacacctacttctccaattatccagcaaacgagcctactgaaacctctttctccggcgagcttttggctccattgaaccgtcaacaacaacaacaaagccacgagctccggtgagcaaccaaacagtccccagtgaactcgtgagaaacaaccggcaaagcccagctgcggcgacgtcgtctcaggtgaacctccgagctccgacggactcgtgatccaaccaccaacgtcgaaaatagacgacctggaagctccaaacttcagcaacacggagaatgaggtatttgaagccatccaacttgtttcatgaattactgaagtcaaatgcacttgccagtagccgtattcttgggttggatgtgggtgataagtacgttggtctagctgtttcggacacaa

SEQ ID NO: 2056 - DNA, 2282 bp, Lycopersicon esculentum
ctgatttttgcgtccccctctctctcacatctttgctaccccagaagatgaaccctactaaattttcaattttttttattttcatgtaattctttcacagtatcagatccttaaaagttttcttcaatttgttcttgcaacctgtttgattttccctcaaagtttcaaactttaaggcaatttcaagaacaagattccattttttgaggtaagggagttaaagggtgttctttttatttatttattggaacttaatctgttggatgttgttgatttttagatgggttttggttgtgaaggtgtttgatttgctcaaaccaaaaaaaataatcatttcttgaaataagggagttaaacagcaggtatctcttctgattggaaaatgaaaagttctttgtttttttgggttgtttaggggtttgattaagtttccagttttaagaggtgtttgagtacaaatttcccccttatgaggtaaaggattatagggttttcctttgacttgtgtctgagaagtttttgtatggattttgggtttctgtaggcataatttcttgaatttgatagagggtttcaattgtgtctgagaagtttttgtttggattttgggtctatgttggcatattttcttgaatataacaaggttttcaattgtatgtgagaagtttctatttggattttgggttgttgtaggcatattttcttgaattagataaaagggattttgcttgtatctgagattgtttttttttaattaggtttttgtgatggtataaatatgatggagaaacttgttcatctagttgctaggaataaagtgttaatttggagttaaaatggattgaaattgatcaagaaaacattgtgcttggaagtttaacttagactccctctaggtatttgtgtgtcgtagtagttgatacttggttggtttcttgtgcttcaatggatgacattgaggataatgggagatatccttccaacccttatggcatgaaccagggttatgagtcatccaatcgccagaagcttcctgttcacgacccttcttattcaaggcatgtcgacaatcagtatgtggaggaggcggatgatgatgaagaagttgatggcgaagaagaagaagaagatgatgatggcgaagaaaatggtgttcagcggatagggaaagatgtgtttgatgacgatgacgatgatgatgatgagtatggtgatttgcagaggcatcaaaagaagaggaagttaaagagcttgttatcaagttatgagtttgcacctcgagtaccaccaccatctactacagctgcaactgctcctaagccttcatttggtggtaggaatccactttcagattggtctgaaaatgagacatttattttgcttgatgcatggggcactaggtttgttcgacatgggaggaagagtcttcgatcagaggaatggcaagaagttgcagacagagtgtcacgggggtccaaaattgagaggacagacacccaatgtcgtaaccgtttggatactttgaaaaagaaatacaaaaaggagaagatgaagtttgcagagactggaagtagcactagcaagtgggtgtacttcaaaaagatggacatgttactaacatcaactccccagaaagctggtgtttcatgtggaatggactctggagagtatgttttcatgagcccaaaagcttatctgaatcgtgctaatggcttggatgagatgagggacagtcctgctaactcataatctgctgatggtgaggaggatggttcagaggatcttccaccaaaaagatcaagaaatgtacaaccaggagggaacgggaatgggaatggacattctttcaaattaatagcagattctatccataaatttagtgagatatatgtgaagattgagaatagcaagagacagcaaatgatggaactggagaaaatgaggatggacttccaccgagaattggaactccaaaagaggcaaattatggagagagctcaggcagaaattgcaagaatacgtcaaggaagtgatgaagagaacgacatgtctgctgaaaatgttagtggatgacaagccagattatctctctattcgttgtatgttggctattttccactgttgtattatatcttgcattttagtttctcaccattgatggctatatgcaaggcaacttaatgtgatgtaagaatgtatctggatgttgtttcaacagtcaataataacattatggaggtctgttaacctaaaaaaaaaaaaaaaaaactcgagggggggcc

SEQ ID NO: 2057 - DNA, 656 bp, Lycopersicon esculentum
ctgatgtgaattttgaatcatcaaaaaccctaagagaagggatcttgaaaaaacccagtatttgttcactgcatatttgattgatatgaatgattctgatgatgaaactccatactcttcaagacccggcgctgccatttacaatacgtcttctcttcgatcaagacgctcaattcgaaaccctacctcttatcttagaaatacccattatgagtataataacgaatttcaatataaccatcatggtggtgctgctgctgcccatgatgatgatgaatctgatgatgaagaagaaaatcaagaatttagcagtggagaaaatgatgttgataattttcaaggtaagaagaagagaaagttggaaactttagtttcaaattacaattttgcccctcgttcaggttcaaaggatatttggagtgaagaggagagttttgtgttgttggaagtgtggggtgagaggtatttggagctcggacggaggagcttacgtgctgaagattggggtgaagttgcagagaaggtaacagaaatggttggtgttgataaaactgaagttgagtgtaggaatcaattagatgtgctcaagaagaagtataagaaggagataacaaaaatggagaaaactggaggtgggtttcatagcaagtggacat

SEQ ID NO: 2058 - DNA, 540 bp, Lycopersicon esculentum
agtcccatctctcaaggcatcaaattgtttggtgcaacaatagaaattcaagaaaaacaagccaaagctactcatcaaccaacaaacaaagttgttgttgatgatgatgatgataatgatcaagaaaaaaggccagacaagatcatcccttgccctagatgtaaaagcatggaaacaaaattttgttacttcaacaactacaatgttaaccaacctagacacttctgcaaaggttgtcagagatattggacggccggtggagccctacggaacgtgcccgtaggagccggccgtcgcaaagccaagccaccatgcgggcccggcccgcatggcgacttggctgacggttgtaatctatttgatgtggctaatcagcttgactttgatggatcagtggtggctcatgaagatcaatggcatctttttccggcagctaagaggaggagaagcacctccgatagccaatcttattgattccctctttgtcgtttagtaattatatattttatgtacgtggaattagtaaatggttaattaatt

SEQ ID NO: 2059 - DNA, 521 bp, Lycopersicon esculentum
cttggatcctgccttgttagtcatccgtagagctaaagggaattttggaagccattcccattcccacacaccaataccaaccagggtggctgttcagtcagtcctacccctaagagaaaggagaaattgcttgcgcgcttcgtcaagtaatagagaggatcttaggccgaacagatcaccggctccgaaggcctgcaatcgtgactttagttccggtggttcgatttgctgccggggtgcaacatttgtgagacttcgaatggagtggaccgtacgcccctgccgctcgccaagcctgaagaaaggagcaacttagatacctctttgttaactatattcctggtttgctaaaagggtccttgggcccaatcaatctctatactcttgatgcaatggactccccaaagccactaaaccgttctcttccacccgatttgaactgaacctcgttctagtgatattttctccctttggaaactgaaactcagttgcctatctgatccttgggctaattgggcctt

SEQ ID NO: 2060 - DNA, 521 bp, Lycopersicon esculentum
aaaaaagtagatttttattttttaatttcaaagaaaaaaaaaaggattaaaatggtggaaattatttcaccaggatttagattttatccaacagaagaagaattaatatctttttatttacataaaaagcttgaaggaaaaaagccagagcttgatagagtaattccagttgttactatttatgattttgatccttggcatcttccaaaatttcatggggaattgtgcatgggagatagagagcaatggtttttctttgtgccaagacaagaaagagaagctagaggaggaagaccatgtagaacaacaaattgtggttattggaaggcaactggttcaccaagttatgtttattcatcaaataataaagttattggagttaaaaaaagtatggtattttataaaggaaaagcaccaactggtaaaaaaactaagtggaaaatgaatgaatatagagctattcaagaagaagttaattcaactcttgctattccaaagttaaggcatgaaatgagtttatg

SEQ ID NO: 2061 - DNA, 348 bp, Lycopersicon esculentum
tagagagaaatatatatatattatatacatacataaaaaaaaaatattgggaaaaatggagaataatgtgtatgataattataatcataataataataataatgtgttaccaacaggatatagattttatccaacagaagaagaattggtggaattttatttaagaaataagcttgatggaaaaagagatgatattcaacgtgttataccgaaatggcaggagaagtgattaaacatgacacggagcaatggtttttcttcattccaattcaagatagggaagcaagaggaggaagacctactagacttacaacacaaggatattggaaaagctacaggtactcctgg

SEQ ID NO: 2062 - DNA, 395 bp, Lycopersicon esculentum
ccttgacaaagagttagtggagtaactacctaggagtaaattcaatagtagaccttgaaaagaactttagcaaagtcatcataaatgctcttcacgtctcatgtactatgttaaggaatggtcacatttctctctgcattaaagctagttcatgttaaaagttgaggccggtagtagtttcaactttcaatttaattccacctttcctggcccacttctgtacggaacaccaatcagaatctttagttcatcttaacaccaaagcatctccacttagacacttactagacttcacataggaggaaaaatatggaactggtggtcctcacacgttctcctcacagggatggaaactaacaaatgggaagggaagagaagcattactgaagctgaaa

SEQ ID NO: 2063 - DNA, 362 bp, Lycopersicon esculentum
gattctctgtgcctagatactgtgcatagacaatatttcctaggttggattacacggctgacccgcctgtgcagaccgtgacagccaaagatgttcatggtgaaagttggaagtttaggcacatttatagaggtactcccaggaggcatttgttaacgactggttggagtagttttgtgaatcagaagaaacttgttgctggagattccattgtgtttttgagggcagaaaatggagaactttgtgttggaattcgtagggcgaaaagaggtggtattggtgggcctgaagccccatctggatggaactctggtgctggaaattatggtggattttctgcgtttttgagggaagagatgagc

SEQ ID NO: 2064 - DNA, 191 bp, Lycopersicon esculentum
taggaatgaggttgaatttgatgatgatggggttgttgggatgaatggttcggataaccaagataagcctagttcatttgctaagacgttaacgcaatcagatggcgaataatgggtggaggtttttctgtcccgaggtattgtgcagagacgatctttcctcgtctggatactctgcggatcctcctggt

SEQ ID NO: 2065 - DNA, 409 bp, Lycopersicon esculentum
gaaactcaaaaaaaaaaacaaatctttctccaattgtcccttcttttttttttagccctctaaagttttcgcaattagaaacaaaattaagtttttcaaactgtctataactcactaaaggcctcgggtttcttcattgatcctctttttttctctggatcagtaaaaaaaaggggcaattcctctgttttactctgttttcctgaactctgttctctcattttatgaagttattataaatggacagaattcaagaaaacaactctatgtctagtatatttgatgagggtgctcaaattcgatcttcattatctcaactaattctaacaagtagtacaaacacattcgatacaattttttctcattgtcaagaaaataaccaaatgagtaatagtcctgtttttgagcc

SEQ ID NO: 2066 - DNA, 1096 bp, Lycopersicon esculentum
gaagagatcgtcgtgtaaggctttcagttcctactgctattcaattatatgatcttcaagacagattagggcttaatcaaccaagtaaagttgttgactggttgcttgatgcagctaaaaatgaaatcgatgaattgcctcccttgcaaattcctcctggaagtttgaaccctaatctttatcctatgttaggtaatgctcctcaaattactactaataaagaaggtcgcattaattgggataataacattccattggaaccacctaataataatgctttgggctacaatcccaatttttttaaatgggatccttcaaatttatccttagctcattcagaaaattcattatctcatcaacatgatcatcatcaaaacttcaatttgatgtctagtatgccattaacttcacatcatcaacctgttgtttatccaccaggattgcctcaatttttccatcaacataataataatattaatgttggagcatcgtcgtcatcagaatttgatcccaaagaaatcaacttccaaatgttgagtaacaattccggttcagaaaatcccttgtcaactagtactaattcctttagacattctattgactccacaaaccaatctataagacctttccattttctgccttctcaaaattgtgatgacacggagccttccaattaagatcatttacttcctctctgctctttataacaacttaagtttttacacaaagtatcgtattggtcatataatttcaacatgataacagagcagatcaacatattattggttgatcggatgtttcattaagctattccactttcaagatcagagcaagttatcaactgtatgttccccggtgagtactgaataatttgatactagtatatatatatatatatatatataacaacaattgtatgttcttttggtcataattattcctatagctacaagactcgtgattggattgtttgggatgcttcaatgtactccaatttcaaaatgtattatgctatataaagttgtacgttcggttattaaaagacaatataatatatatatttttggccccaaacaaaaaaaaaaaaaaaaaaaac

SEQ ID NO: 2067 - DNA, 628 bp, Lycopersicon esculentum
acagaagactttaatgccattaagagattcttgtgagctgcaaaatctgacttgagttcaatttcatccttcctcaattccttatacatagatatcttttcatcctcaacgcgtcccaagaaatagtgtatcagatcaacagcaacaacaacaacagagacatcgaggattcagtcttttatatatctattgatcaatgatgaagaaaagagtgattagtacttgatcattatgaactcaagaaagcaagaaactggttcaggggttgataccaacaacagtaaaacaacgtcaacgactactgctactactattccatcaagttcttcttcaaggcagtcatcttcatgggggaggagggtttaaaaatccaagaatagtacgcgtatcgcgtagttttggagggaaagataacacagtaaagtgtgtacagtaaaaggattaagagacaggagaataaggctttcagtaccaacagcaattcaattgtatgatcttcaagataggcttgggttaagccaccaagcaaagttgtagattggctaatagatgcaactaaagatgaattgataagcttccacctttacaaataccaccaccatcactctctcatttcttcagtacgaaa

SEQ ID NO: 2068 - DNA, 738 bp, Lycopersicon esculentum
  misc_feature (673)..(673): n is a, c, g, or t
gctagaatctcgctatacgaatactcaatcgatttatgttcatgtactgctattttgttaattgtccgtttcaatatacaattgtgatcaacaggttgttctgaagtttcctccctcagtttttgatgggtgcacctaagcaaaagtggacttcagaagaagaagctgcccttaaagctgggatacttaagcatggaccaggtaaatggcgaacgattctcaaggatccagaatttagtggagtattgtgtttgcgttcaaatgtagatctcaaggacaagtggaggaacatgactgtaatggcaaatggctggggttctcgagagcaagcaagattggctgtcaaaaagatgagacaggcccctaagcaggatgggagtcctttgactgatactactgctgctgatagtgatgaggaagcagctgaaacaaggactgtcacaacttctagtggttctcctcagacacatggttcaaaacgatctatgataaggttggataatcttataatggaggctataaacaccttgaaggagccaggtggttccaacaagatcacaatagctgaatacatagaggaccagtactgggcacctccaaattttaaaaggctactgtccgggaaactgaagtatttaactgcaacagggaaacttatcaagatgaagcgtangtatagaatagtacctatgtcaacaccatctgacagtagaagaaacctgtcccttccacttttgg

SEQ ID NO: 2069 - DNA, 748 bp, Lycopersicon esculentum
gctacaaactttaaaaggctactttcagcgaaactgaagtatttaactgcaactaggagacttgtcaagatgaagcgaaagtatataatagcaccaacactggtattatctgacagaagaagaattccttccgttcctctcttggaaagcagccagaggatctcctcccgggttgatccggatgatataaacacacttactaaggctcaagtagattttgagttaactaagatgaggagtatgacacctcaagaggcagcagtagctgctgcacgagctgttgcagaagcagaagtagccatagcagaagctgaggatgctgccagagaggctgatgctgctgaagctgatgccgaagctgcacaagcctttgcagaagctgcaatgaaagcactagaagggagaagcatcccaaggatgatgatccatgcttgatgggatcttccagagttgtggcttgatactatagctttgatggattttttccattttgttatttttcaaacctttagccagctacttgctggcttgtaaatttggtaaatagttgtggaaatgtatacactgtttgtgatagtaaagcctttccggtaaatagcataaaaaaaaaaaaaaaaaacttcgagactagttctctctctctttttttggagaaattgtgcgatttttggaagagagagttatggagtagaacattgaagtttgaaaattctcgcgatgacgtttgatgaagtgtcaatggagcgaa

SEQ ID NO: 2070 - DNA, 608 bp, Lycopersicon esculentum
ggccttctccatttttcttcattcaacggcatctctctcaaattcgccggaatatactccaccagcggaagaagattttagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcac

SEQ ID NO: 2071 - DNA, 508 bp, Lycopersicon esculentum
caattatgcagcttatgaatgtggaaggattgacgagagagaacgtagcaggtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtagctccacaagctgggacctggatgatgtcatttgatcgtggaggaatcatggcaggttcatgaagtgttgttctctggtaaaatgtgggacaaatatga

SEQ ID NO: 2072 - DNA, 1236 bp, Lycopersicon esculentum
gggaaaccctagttccggcaccccccataaagctttactcttttggctttcttttcagttttccgttcgatccgcttcggaattcaacggacttttcggcgagttcaccgtgcgcgaagaggaattgacgatttccggtagagaaacctctcctgttatctgaagaattgtcggtcgacgggcggtcggttggtcgtcgctgattggattcgattcaattcaatcgatctgaagaatccggtgttctataaacccatagaaagcttctgagtttatcggatagaatcatcaacctcttcaagggtatccgctaagagagacgcccggcgtgattagatagatcggatcgagatcgtccccagtcgaaggagtagcggtagcagtggtttgattttggttataataagcttgcctttagatattgctgctgacggaagcttgcggattattttgctcgtggaggatgttcctactgatctattggaggaatttggtttgactgattttcttgagttattgaagagaagttgtgagctagaaaaaagagcttttaatatttttgtactttatatcaattttctttgagttcaatatcaggcctattatgattttttgatcggcctcgttgttgttatattgtttttgtttgaggaaaaaaaggaattttaagaaaaaaggagctatgtcagtttattttaagtttaaaagtgcgaaagattatgattcaattccaattgatggtcactttattactgttggtaatttgaaagaaaaaatatttgaatccaagcatctgggcaggggtacagatttcgacctcgttgtcaccaacgcccagtctaacgaagaatatcttgatgaggacaccttgattcccaaaaatactagtgttttgattcgtcgcgttcctggacgacctcgcatgcccatagtaactgcacctgtaacagaaccagacgagccccaggtagaataccgatctgaggaggctcaagcagttagaagtaattttgtgggaggggagtcatctgccaccaaatatcctgaagatcttgaatgggatgaatttggaaatgatctttactctattcctgaaacaatatcagtacagtcaagcaaccaagtgcaggatgctcctcctccaagtaaagctgatgaggagagtaagatcaaagctttaattgacactccagccttagattggcagagtcaaccctctgatggctttggtgctgg

SEQ ID NO: 2073 - DNA, 332 bp, Lycopersicon esculentum
ttttttttttttttttttttttttttcctgcctccccaactacaggcttttgctgaacctcttcatcagccaatggagcactccccggggatacaggttctttaacactgacggactcgtgtgtagcttcagaaacatctgcaaccttcaaagttcttcctctttccaacatttgctgagaagcactgccattcttaccctcttctgcaatctcctgggctttagaattttcctccttaacaggtggaggaggtggtggtggtggcaacggctcaccccttgaagctgcagattgtgaaggagatggaatctttggtgggagaatgcgcgct

SEQ ID NO: 2074 - DNA, 533 bp, Lycopersicon esculentum
ctagcaaaaatatttcagttatggcagtgtatatcaagtataaaagttgtaaggattatgattcgataccaattcttgatcattttatttctgtgggcaatctgaaatcaaagatatttgaatccaagcgttatggttggggtaaagatttcgacattcttctcaccaacctacaaactaacgaagattatgttgatcatgccaccttgattccaagaagtacaagtgttttgattcgtcgcgttgctggattaccttgcttccccattgtaatcaaagaggagcccaagcaagtgctgtgtaaacaggaggaggttcattcagttaaaaaagagtccaaatattctcaagatattgattacaatgattttggcgatgatgtgtatgtaattccaaaaatagcagtgccaattcaattaggcagtccagagtccagttgttctagtagtataatcaagaattcagtaggaaacatatcgtataataacacaagatcagctggctctagtgttggacaaggtagaacggaatgg

SEQ ID NO: 2075 - DNA, 1746 bp, Lycopersicon esculentum
gaaaaaatctccaactttataggacataatattaagattagctgtgtcctgatctcctcttaattaattaaagtaagtcactaattcctttaatttccttatatattttactttttatgtgtatccatttccacaattttatttggatttttttttatttttgttcaggatttctccacattgtttttgggatttttcaagaatttcgtaatttacgaggtacaattctatccactggagcgaaataaacttttagcgagaattaaaattttttctttttactcgatagaattgccacttaaatataaaatagtcaattgtgggtaaaaaaaaagttatttttgttgcaaaaatgtgtggtttcaaagcccaaactcttaaaaatctagacaatttttcacgttttttttttcaagattattgaaatttagaattgaatatttatatttttgttgcaggaaatggaatattatgggtttaatcaacattggcctattagctcatatgatgagctaagtgcaatatctatagcaaattcatttggtcatgagaataatttgcatgaatcattcatctctcatcatcagccactattatgccataaaaggcctatagaattgtcccaaattattgaagaaaggccactaaaaaattccaaaacaagtcatagctggaacaatactattgaaattgatcaaatattgagctcacaatctgtggtttctcccaattattcccatttgatgaactcatcaaataattacactaaccaacaagttgtgacaatgaagcccaaagaggaaacaactaatttgtcatcaagcagtataacttttgcagctgatcattgtcataacaatatggtttgtcatcaagattcttttgctaatcagaattatatgatgtttaaggctgcatcatgtcaaggtgctaataagagtgttagcactaatggaaaattaacacaagctcaagatcatatcattgctgagaggaaaagacgcgaaaagcttagccaaagattcattgctttatctgctctaattcccggactcaaaaagatggacaaggcttcagttcttggagatgcaataaaatacttgaaacaacttcaagagaaagtgaagacgcttgaggagcaaacaaagaaaaaatcagtggaatctgttgtatttgttaagaaatatgaactttatggagatggtgaaaattcttcatcagatgaaaattactcaagtggtactgtgccagttgatgaggcactcccagaaattgaagcaagaatatctgaaaaagatgtattaattagaatccactgtgaaaaaagcaaaggagttgttgagaaaacagttgctgaaattgagaaacttcatctatcagtcatcaatacatgtgccttgtcttttggaacttctgctcttgacattaccataattgctcagatggatgaggaatttgcaatgacagtaaaggatcttgtcaaaaatttgcgctcagctctcaaagtgtttatgtgaaggggtgtgatcgttgaccaacttatcgtaatttcttttaaagcgtttgatacaacaaaagtcattttaccgttttctttttccagttctataattggatgtttagggttgtgaggtcaaattcaccttttttttttttcaaaaccaagtcctttgaagcttgtttgccgtggggttaattaagtcatttttttagggaggatttattttttaacctctcatttttgca

SEQ ID NO: 2076 - DNA, 616 bp, Lycopersicon esculentum
ctgaaatggtatgagaactcttgtatactgccttgttggggagaggactattaattgtatttgattttatgtaccgatagttattaacaatattttttttcatttaatcaaatactacaggagactagcaatatgaatgatcacaactttgttaatcagagccaggcgatgacacaatttaatgaatttcctttcaattctaagcccttttctacttttacccctcctcctccctccaatgtaatttctaattacagctactccaattcaatgtcaaccaaaaatcaattcgaaaagttgaacacctttaaagtcgttaagcatgaggttccatctggaactacaataaacttctcttcttccgttaattctatggacgattctgattttggtgatatcgaggccgccatgggatttggtgctgctattacgactactactgatcagaagaaaagttacaatagaacaagtgttcaggcacaagatcacgttctagcggaaagaaagcgaagagaacgcttaactcagcgttttatagctttatctaccctcattccaaacctcaagaaggtaaatctttttttcttcttcatattcctgctcaaatcaattgaat

SEQ ID NO: 2077 - DNA, 429 bp, Lycopersicon esculentum
atgcaagatcaagctctcattctacatgagacttcaatcaagagtttaagcattgataataaacctggtcttcctaaaatggataagagcatgaagatggatgatgcagataattcaattccgccatggaaatccaacgatgtcaagtcgtggatatggatgcagcatgccatgcatccagaggtgaactacaacagctatttccagaaaaaatggatgccgtggaacataggaccactaaagaatgtgtcaatcaagaaatggatcaaagaaattaagcagaagaggaaagaagaaaagagactacagaaggctgaagtacatgcagcgatatcagtggcaggtgttgcagctgccttagctgccatcgctgctgaaaacatgaaccatgatcagtcagggtgtaccaaggagtcagctgtggccagc

SEQ ID NO: 2078 - DNA, 731 bp, Lycopersicon esculentum
aaaaaataaaaaaaaatctcaaaaattgcaaaaaaaaatcatggtggttttaccaatgaaaagagaaagagaaggagaattcgatataacaaccatggcaaattacttgatgttattttcacgtcaagaaaatcatttcaacactatggtaaacaactctcctagtcgagttttcgagtgcaagacttgtaatagacaattttcatcgtttcaagcactaggtggtcatcgagcaagtcataaaaagccgagattaatgggagaaatgaattttcatttgccgatttcaccgcctaagccaaaaacacatgagtgttcaatttgtggacttgaatttcctattggacaatctttaggtggacatatgagaagacatagaggtatgttaaatgaaaataataataataataatcaagttcctaatcacgatgttatgaagaaatcatcaaataatccaagagttttgtgtttggatttgaacttaacaccattggaaaatgatttagagttcaagttgaagaaggcaaatcctatagttgattgctttttgtgatcaatcaataatattggatcggatcgcgaatctacgataggagttctacgagttcaaagttatcaatccaatcatttacatatgctgaactcgctgattcaaaattctgaattcatatcgatatatttttgcacatatatatctaaaacatctagatgtttcattattttaatttttt

SEQ ID NO: 2079 - DNA, 1667 bp, Lycopersicon esculentum
gcgtcaccgttccattttttttctctctctttcatacccctagggtttcatcttagctcgttcgatttcgcctgaaaaatgatgccacaaagtggagttgctcagccagcaatggcacctatgtcaatggatcagtatcagcagcaagctccgccgacgcagcagcaacaacaatggatgatgcaacctccgcaagctcaacaacctcaatttcaaccttcttggggtcagcagcaacaacagccatcgcaaactatgtctcaacagtatgttgcgactaattctagccctagctcgaatgttaatccaaatgaggttaggtctctttggattggggacttgcagtattggatggatgagagttatctctccacttgtttctatcacaccggcgagcttgtttctgctaaggtcatcaggaacaagcaaagtggccagtctgaaggttatggattcctcgaattcaggagtcatgcggctgcagaaactgttttacaaacatataatggcgccttgatgccaaatgtggaacagaatttccgtatgaactgggcatctcttggtgccggtgagaggcgagatgattcacccgagtacacaatatttgttggtgatttggctgctgatgtgacggattatgtgctacaagagacattcaaacccgtgtattcatcagtaaaaggtgcaaaagttgtaacagatagaattactggacgtaccaagggatatggatttgtcaagttctctgatgagagtgaacaattgcgtgctatgactgaaatgaatggtgtactttgttcatctaggcccatgaggattggcccggctgcaaacaagaaaccaatgggtaccccccagaaagctacctaccaaaatcctcaagctactcaaggcgaaagtgaccccaataatacaactatatttgttggtggtttggatcccagtgttgcagaagagcatttgcgacaagttttctccccatatggtgaattggttcacgtgaagatagtggctggaaagcgctgtggctttgttcagtttggtagtagagcttctgctgagcaggctttgtcaagcttgaatggcacacaattgggaggacaaagcattcggctttcttgggggcgtagcccctctaacaaacagtccgatcaggctcaatggggtggaagtgccggtgctggtgctggtgcatattatgggtatgcccaaggatatgaggcttatggatatgctcctcccgctcaggaccctaatatgtattatgggaattacccaggatatgggaattatcagcagccacagcagtgaagtttaattattttcaaggaggctaagaagtagacgacgttcaaatttccagtgcttaggctgatctttcccgtcggtgtgactggttgtacaatgaatttgataaactgagtgattgtgagtttttgtgggacattttcttttctcctgtctgtaacttgagtttgctattacactaacgtgtaccgaaacattccaaactgtaccttgacctgtgtgtagactctgttaagttttttcttaccaaaaaaaaaaaaaaaaaaattgcatttggtttgcttgtgagcagcatctagtaaatgtgatgcttataattgacgaaacaaagatggtagagaaaaaaaaaaaaaaaaaaa

SEQ ID NO: 2080 - DNA, 738 bp, Lycopersicon esculentum
tttttttttttttttttttttttttttttttttggagcaacgagcaaaatagggtgttcagcattgccaggatagccaaaaagcacaagtatacagttacatgcctacacttctccaaagaccttcaagtatatctagatctcatatctaagtaataaaagggcaacgcaaaaataaaaaaacaaacagcatacaatcagttgatcgaaaccataaattgtatcctcaatgaaatagcctacaaaggtttccaacaccctaagattgtgaaatacacatctggatcccaactgataacctcatgtcccgcttttgaaatcaatacacaaatcacgccgggaagcactcagtaaatcctttcaccagcatatatcactgaggatgctgcaaaacttgctgctgctgttgaggttgtgcgtaatttccatatccagcatagcccgcataatactgatttggatcctgagcagggggggcataaccataaccttcatatccagcagtatacccataataaccagcatattggtttggatcaagctgaggctgctgcttgtttgcaggacttcgaccccatgaaagacggatgctttgtccacccagctgagttccatttaatacccgtagagcttcctcagcacaacttctgtcagcaaactgaataaagccacaccgcttgcctactggtatttttacatgaagcaactgcccatagtgtccaaaaatctgccttaaatc

SEQ ID NO: 2081 - DNA, 604 bp, Lycopersicon esculentum
aggccgccaccgcgtgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttggtggagacttggcagctgatgtcactgactat

SEQ ID NO: 2082 - DNA, 600 bp, Lycopersicon esculentum
gcgccgttgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatg

SEQ ID NO: 2083 - DNA, 723 bp, Lycopersicon esculentum
ggccgccaccgccgttgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgcagcagcaatcggcgtattattaccagcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatgcttcaggagacattcagggccaactacccctcagtcaagggtgcaaaggttgtgactgatagggtcactgggcgcacaaagggctatggggtttgttaaatttgcagatgaaagtgagcaattgcatgctatgactgagatgaaatggcaagtctgctccactagggccatgcggataggccctgcagctaacagga

SEQ ID NO: 2084 - DNA, 364 bp, Lycopersicon esculentum
tcaggatccaaatctatattatgggggttacgctgggtatggaaattaccctccacagcagcaacaaccacagtgatctctgctggttaaaggagtcgacgaaagcttcctagcacagtaatgcaacgatgtagaaagggaggggcatggattcgaagtttgcatcagatttagtataagataaactactgtaggctggttcttgaagatcagtatttatggttgtgttcaaccatcgcttactttttcattagttaccttctgttatttttcattggtttttttgttgatctttttggtttttgcgcttttatgtttacttttcatgagtcccacttggtacttggatttttgttctagttgg

SEQ ID NO: 2085 - DNA, 755 bp, Lycopersicon esculentum
tttgattattcggttttgttgggggcagtagctcttgtgataagagtggttaattatcagtttaagctgtagttcatttagcatatgaatttggttgttttcaacttctacaatcagtatagctgcacaactcttgcgagtcttaaacttggatgaacttgctttgttgttttccactgtttaagggaagagcttgccatatatgttttagactgagcttaacctacaattttcctcattgttgtttcttgtttgattgaatcataagagttttgaatagattaattcattatgcttcgaatgtctgttctctcactctatttcttaatgcatcgatttttacttctatttcacattaaagtcgatgagttcttagctttgttctgagaaatattaaaatttgttaaagaatgactaaagtcccacatcgatggttaatgagatgggtggacggactccttataaaacttggacaactaaattcttgtcccttccctatatctgtgccttgtcttctcatatcatttattcccatgattttcttatcagtgttccatgttgctagtttctatcggaatttggaactaattcttatctgtttttgttttgttttcttaccaaatcccttttttgagtccaaatagattctgtctcgatatcttgcacctcccaatggttcatatttctcgagtcagccccatggcaaattgtgaaagtcggtgacaggtctttggaagctgatacagggtttcgca

SEQ ID NO: 2086 - DNA, 471 bp, Lycopersicon esculentum
gcaccgaggttcaagatttcccagatcataccagtctaacaaacatatcttttttttttgtcaactaagtagtaattaatcagttcttgtatttaaggtcaaaactgattaattattggtattaatggataatttccattcaatatttcctttacaaccggatgatgatgcgaattatgattcccatcaacaacagctcatttttccacatgaaacctataccaacccttgtaatttcatataccaacaagatctggtaaatgattttgcttcttttgattcattggagttaagagacaacaatcttacatttaacaacaatactaacaacaatcagaaagggaaatcatgtggcgttgaggataagaagaaacacaagaaagtgatgcatagagaaattgaaaggcaaagaagacaagaaatgtctactctttatgcttctcttcgtcaacaacttcctcttgaaaatat

SEQ ID NO: 2087 - DNA, 572 bp, Lycopersicon esculentum
ataaatgcagaaaatcctttattttcatcattgctttatatacatcgcaattttcaacaccagaccattagtgaaattaagctgtaccaacgcattctctacaaacccccaaaaaccctactgccaaattttattttatttatttttaataaaaaaagtctaattactgccaaattttatttatttattttttaaaaaaaaaataaatctaattttgacaatatcagaccatgtgcctcatggtaaaaagcttgtagaaatgcagttgcatgatatgttattaattgtaaactgagaactataagtccaggttgatcatatcaatcactttttgttgcaatgccaagtgatcaatgttgttcatatcacacgcctcagtgtgaattgagtagagtgacctttgatccgcttttgcagaaacacaactcaccacattaagcccttgtttcaaaagctcacccagaatttttgaaagaggaaaagttttcccttcacaatcgacgctgattgagatctctataccttcctgcagccaggggctaactgtgacagtacaatctgtgaatctgtta

SEQ ID NO: 2088 - DNA, 542 bp, Lycopersicon esculentum
ggggattcctgcatctttggagcttgatcaactgcagcagagcaagtgtgccacacacataggagagttgaatcctttggatgagtcaggactgcatacagtggccagtacattcacgaactctagattggttggtagcgcaaacagctctatgcccaatgtatcaaataatcctattttgcttcaagtaaattcccagcaaccactgacggggatgggatttggaaatcagacttctctcaacgtagcctcttttagctctgaggccttcaatactggtgtaagtggttcttccaattttctggaccatgatagatattctaacgagaattggcaaacttctctccagcctctgaagttccagtcaacctcctttccgttaaatgaacctttcagcaacagccatttgcctcaagacagagtacgagacaatgatacttcaactggccctcatttgcagaacaatcctgttgatttttcaacctccaccatagtttccgtacctttcgaagcttcaagaggagaaacacaatgccgtgaaa

SEQ ID NO: 2089 - DNA, 443 bp, Lycopersicon esculentum
  misc_feature (17)..(17): n is a, c, g, or t
gagaactagtctcgagntttttttttttttttttttttttttacctttaaatctcaaattcttgtcaatctgcacaatggatttttgattttcacatttacaaactaattagtgcagcctatgtatacaacaactctaacagccatggataacaaatactaatcccccaatgggatattatttaccccaaactccagggggcggaaggcttaaaagattcttctcccattaattccccaaaaccaatcaaacctcctttgaaaccaccggcttcccctaatttgaacctggcggcagaacaatggggttcttgcttgtcgaacacaaaattcaccaccctccaaaacgggcccctaccccccgggaattgaaccatcaactttaccctttccaaagccttctgcaacctttcttcagttggctttcggccttcttttaaaaaa

SEQ ID NO: 2090 - DNA, 734 bp, Lycopersicon esculentum
gatcatcacaaaaatacaacgataataactacgcctcaatttcaaactgatcagaataacaagttgtttgaaggtttacgtgccgataatactattgatttaccttcatctcatcattatcaacaacaatgtttgaaaggaagtgagtttgatgttgatgagttaggggtagaaaggtcattaatggagaagaagctaaatcataatgcaagtgaacgtaatagaaggaagaagatgaattttctttattcaactcttcgttctttgcttcctcctcctactaataaacatcaaaagaaaaaattaagctttccagcaacagtatcatatgtacaagaatacatcccagagttgaagaaagaaatagagaggctaagcaaaacaaaagatttgcttttatcaaagaaatcaaattattcattactcaaaattgatgataataataagagaaaattaattattggtggaacttcttgtaattcttcaacaacatcaatttgtgcaagtcaactaagtaattcacaagttttggtacaaatttcaacaactcaagaaaataattttccaatttcacaagtatttgcaagtgtagaggaagatggattaattttgctaaatgcatcatcctttaaatcttttggagacaagatttttcacagcttgcattttcagatgcaaggaccaattgaaatggacattcaggttttgaagactaagcttttagtaatgtgtga

SEQ ID NO: 2091 - DNA, 605 bp, Lycopersicon esculentum
gctgttccatcttctccccttctttatcctcataccaaaatcactcttcaaaggagcgaaaacactcttccaatctcaattcttcgcctccaccgacgtctactcgtatcaaatcctcaaccaccaacgctatttactcttcatggtcttacatcaaacgtattttctcatccaataaacaaaaaatcaacaacacccaaactcacaataacccttcaattcaatctccctgttcttcaacaaggtccctgcaaaaacccatttcatcagatgacctaattaaccgctccgtttctccaatacccgaatccgaaatcacctccgatcaattattcttccctttacgaaacgatatctacccatgtactttatgtggggaagtattccaaagccccattcatctcgaacaacaccaatcgattaaacatgcaatttcggaactcacggatgaggattcgggtaacaatatagttcggatcatttttcaaacgggctgggttgataaagagaaaaacccggttatcaatcggatccttaagatccacaacagcaaacggatcctatcccggttcgaagaatacagagaatgcgtgaagctgaaagct

SEQ ID NO: 2092 - DNA, 956 bp, Lycopersicon esculentum
gctctctttcttcaaagcttgagcggtttatctcgaattttccgtagggttcttctctgatcgctttcaactttcgataacagagaaacctagcaatgtcatcgtcactccatactgaagattctcaatggaaaaaccctagcatttatagccgcaaggacaaatcgctcggtcttctttgctccaagtagaaatgtgtggaggaagctgatgatatgccttaaaaacataaaaacccaatttcttgaagctatgtgatcgggaaggggtggactccaccattggtttggacaatgctgcagatcaattaggtgtcgagaggcgtcgcatttatgatattgtcaatattttggaaagtgttggggttttgtcaagaaaagctaagaatcagtatagatggaatgggtataatgcaatttctaaggctgtagatttgcttaagaaagaaggactaaaagatctgtccactgtctcctccacttgccacaatgtttcaaatgtcatagcttgtaacaattcagatgttaaggaaaaaggagaaggcaagactgctggatcacataaaattgacaaccggaaggagaagtctttgatgattctagcacaaaattttgtaaagcttttccactgttctgatgttgacttgatatctcttgacaaggctgcatcagctttgcttggtgatgtccacgatccgatggctatgaagacaaagaccagacgcttgtatgatattgcaaatgtttttgtgtccatgaatcttattgagaagatacgcagcccagataatggaaaaccagtgtttaggtggatagcctggaaagaaaatctgaggagtgggtcccttgcatctgctaaatcagatgattcaacaaggagaacttttggggcagagatcacgaatacaactcccaaacgatacagggatgattcttcatctgatgtaatgtcaaatg

SEQ ID NO: 2093 - DNA, 1153 bp, Lycopersicon esculentum
ggtcatggggaactactgtttctggtcaatcggtttctactagtagcagtattgggtctccatcgagcagaagtgaagccgccatggctacccctgccagtgacaacacttttcttaggctaaacaatcttgacattcatgctgatgatgcaggatctcaagggacagctgggaaaaagaaaagagctcagcgtgctactggaggggataagagtggtagaggactcagacagtttagcatgaaagtttgtgagaaagtggaaagcaaaggaagaactacgtataatgaggttgcagatgaacttgtagctgagttttctgatgctaccaatagtgttgcaggctcagatcagaaacaatatgatgagaagaacatcagacgacgagtctacgatgctctgaacgtacttatggctatggatatcatttctaaagataaaaaggaaatacagtggaagggattaccacgcactgatgcaaatgatattgaggagctaaagactgagcgtcttaacttgagaaataggattgaaaagaaagcagcttatttagaagaacttgaagatcaatatgtagggcttcaaaacctcataaaacgcaatgatcagttgtatggctcaggcaatgctcctagtggtggtgtggctttaccgtttattttagtgcagactcgtcctcatgctacagtcgaagtggaaatatcagaagatatgcagctggtgcatttcgacttcaacagcactccgtttgagctgcatgacgataattatatcctcaaagcaatgaatttttgcggaagatcaaatgacggttctgtcccacagaatgtatctgctgatggaggtgaaggtccgagttccagtatggccaacatgtttcagcatcatatccctaatccatctgccccaaactcatctggcaggcttccgacctcacctcctctccccggaatactaaaggctcgtgtcaagcatgagcattagtcttctggcttctttcttgatcgattactgtactcattaacgcatagtatttctgtacattatgtaaagtatttttactggaagcagcctcctctgttgactaaatacttctcttgacccttgtctcaatttgagggaggttactagttgagcttttaaatttttttgct

SEQ ID NO: 2094 - DNA, 993 bp, Lycopersicon esculentum
ggctccatgtacatgggatcatcatcaggaagcttaagtatgaaggtgcatcaattcacacgtggattcttagagcatgaagctgcttctccttcacttacacttggttgcaaacgtttaagaccacttgctcctaagctcaacacaaccaataatgataccacaactaccattgttactcctccttttgatcttaagagtttcattaggcctgaaagtagcaatagccctcctaaacttgcttacaatgaagacaagaaagactcctctcaggtggaatcacacccaggaggaacaagatggaatccaacacaagaacagatagggatacttgaaatgttgtatagaggtgggatgcgtacacccaacgcacaacaaatagagcaaatcacagcacaactaggaaaatatgggaaaatagaaggcaaaaatgtgttctactggtttcaaaaccataaagcccgtgaaagacaaaagcaaaagaggaatagtcttggccttagccaaagtccaagaacaccatcagccatagtcactagtcctttgtcatttgacactaggggagaagtagtgagggatgaagatagtccatacaagagaaagtgtaggggatggacatttgaatacatggaggaagaacaacaacaacaagatgaagaagaaattataaattgtagagaaaatggtgataggactcttcaactcttcccattgcatccagaaggcatgagatgatgaatttattataagaatattcttttttcctttttaattatgatctgactagcttccttttttttttttacttattttcgtcatctttaatttttactttcttcatttgcatgctttgtttccttttcttttatttttttccttgttttgggaaagagaaaagagaaaagagagacatatgaatcatcaaatctatgtagtaccaattcacttctcttgaattttgggcattttagtgaaaaaaaaaaaaaaaaaaaa

SEQ ID NO: 2095 - DNA, 561 bp, Lycopersicon esculentum
gcataaacaaaaacctaaaaaacatccttcatttctttttcatccttttgtcttctcacttactaaagtccccctttcattttttttttcttccttcttattaacctttttttcctatgaataaagataattctttttatttttttttggtatgaaatcatcttgaccttaaatttaatcatctactaactcttttaactcaaaaacaaaaaaaaagaagataaaaaagagtgttagatgtttcagccatggagttaaccaacaacaacaacacaactattagtactattactactactactacagtgaaaaccccagaagctgaaattgaaaccccaactcagatccagaaactgaaaccttttccttttagtaatggtgttctgaaaaggaaaagttcatttaaccataacaatcatcatcaccctgttgtggttatttacagagagtgtttgaaaaaccatgctgctagtttagggggtcatgctgttgatgggtgtggagaatttttgccgtctcctgcagcgaacccatctgacccaacttcactgaaatgtgctg

SEQ ID NO: 2096 - DNA, 639 bp, Lycopersicon esculentum
  misc_feature (591)..(591): n is a, c, g, or t
caaaaaccaagatttttgttatctatagtcataaactctcatcatcatcaaaactcaaaatcccaaagaaaaacaaacccactttttttttttcttctctttcttaacatgctttttcttttcattttcttaatcatctaagttctaagagtgaggggaaaaaaagaaaaaagataagtagtagatgtgtttcaggtatggagttaaacataaacacaaacacaacagctgctattactaccgtgaaaacaccagaattagctgaaactgaaactccgagtcggatccagcaaccgaagcctttttcgttcagtaatggggttttgaaacggaaaaatcatcatcatcctgttgtggtggtgtacaaagaatgccttaaaaatcatgcggctaatttagggactcatgccgtggatggatgtggagaatttttgcctattccagctgcgaacccagctgatccaacttcactaaaatgtgctgcttgtggttgtcaccgcaattttcaccgccgtgaaccggaagaaccgccgcctatcgctaccgcggctattgagtaccaaccacatcaccgccatcatcctccgccgnctcgtggggaccacggtagcccgaattcaccatctccaccgccgattt

SEQ ID NO: 2097 - DNA, 594 bp, Lycopersicon esculentum
ctgaccaggcagtttgggctactgaggatgattataaagcctggaacagtggtccctattgtgaaaccccttccaattccagtcaggatggtaggcattcacaaaaccggtcaggcagtgagcctcccaacaagaagtcaaggaatgtgcaggattcagatgctcgcattatagtcaccagtagctctaaagcaatcggaaagatgttctttaaaacgaagttgtgttgtaagttccgtgccggtgtctgcccctatgttactaattgtaactttgctcatggaatagaggagcttcgcaaaccaccacctaattggcaagagatagtagctgcacatgaaaatgagcggggagtaatggtggaactgagagaagaacaccagataccaatattgagctctcctgatttacgtggagagtctcaaaggtccgctaaagggaggcactgcaagaagttctacactgaagagggatgtccttatggagatagttgcactttccttcatgatgaacaatcaaggtctagagagagtgttgcaataagtgtgactcctactgttggtggatttggaaataatgctactggagcaaccc

SEQ ID NO: 2098 - DNA, 823 bp, Lycopersicon esculentum
gctcttctttctcttttgcctcaagctttttttttcttcttcttcttcatgggtttctagttagattttctgaagtgactttaatttttttttgtaaagttttgatttttttttctctggcattttgaatgttgttttggggttgtcttcttgagagtaatgggtgttcactgttgttttctgatagctaaaaaaagggatttttactaacttttttggtgtttgtagttgggattttcttgaagtgagtttaatttgtgtaaagttttaatctttttcaaggcattttgaggaatgctgtgtggggtttgttttctgatagttaaaaaagaagcatttttcataagtagataatgtcagtcaagaatagaaagatatcttcttgactaacttttttgagtttcagggggggtggaaaaagatgatagctttaggaaagttcatttcttttagaaagttatctgagtataagtagaggaaaagttacatttttttagttatattgaagggttgttgaaaagatagaatcttgaaaatgggggagaagaagaatatgccagcagtttggtttactttaaagagatctttgcattgtaaatcagggccatcagatgttcatgacccaaaaacaagaaaagagttgagcacaattttgaccaaaaagggaggaggaaggtctggttgttcaaggtctatagcaaatcttaaagatgtaatccatggaagtaaaagacatttggataaaccacctagttgtagtcaagatctattggtagtagtgagtttattaatcaataactcatgaaagtattctgagtaattc

SEQ ID NO: 2099 - DNA, 478 bp, Lycopersicon esculentum
  misc_feature (466)..(466): n is a, c, g, or t
ggaggaggagatttaaaaaaaaaatgccagcagtttggtttgctttaaagaaatcattgcagtgtagatcagagataaaagatgtgtatgatccaagaagtgaagggaaaaatttaagcaagatatcgacgaaaaaggcgacgacaggtaggtcaggttgttcaagatcaattgcaaatctgaaagatgttatacatggaagtaaaaggcatatggagaagccaccattacagagtccaagatctattggaagcagtgagcttttgaatccaattacacatgaagttgttttgagtaattcaacttgtgaactcaagattactagttgtaatttccaagatggtaatggtaatgggagtagtgggaataatgttgagagtatttctgcttttatgggtactttaaaaccagggacccctggccctggaggacaccatattggttcatcaaggaaatacagaggctntggtagtcctat

SEQ ID NO: 2100 - DNA, 606 bp, Lycopersicon esculentum
ctcatatacaactactacgattatcaaaaatgacgagccaagtagcggaaaacttcacaaaatactttgaaaattggatgatccaacttgaagagttgctgaaacaactcgttattgtacctagggagacgtcatacgtgaatgatcacgagttattggtgagtaaaatgacgacacatcacaagaactactacacagccaaatgggccgcagctcatgaagacatcttagcatttttcactccaatgtggcttagtcctttagaaatcgtctactcgtggatcacagggtggaagccttccatggcgtttcgattagtgagtggcggtggaggagcgttttcggatgaggaattgaagaatattgatggtttgagggtgaaaattcgcggagaggaagagaaagtggagagggaaatggagaggcaacaggttgcaattggggatagaaaaatggtggaattagcaaggattagaaatgataatgatgagttggtagaattggcgttgaaagggttaaggatgagtttagaaagggttatgaaaatggcagattgtgttaggcttaaaacgttgaaaggtttgttggagatattgagtcctttac

SEQ ID NO: 2101 - DNA, 454 bp, Lycopersicon esculentum
  misc_feature (15)..(15): n is a, c, g, or t
gggagatatctttangcatttttttttttttttttttataaaagtaaataaagtgactacccaatcaccaataacatctatcaactactccaaatgaagcaagcatatcaccacatctcagttcaaatgtttgcccatagtgtgcacaaactttgattacattccataaatcctcaccttcttctcaaatctcatcctaaatatttagctcaaggttagacctggtgccctaatgtctgcaggagaagccctaagctgtctgcataagcagcggccttaccgcatgataaaagggcgactgcataaaccctgtgctcaaggcgtacgaaactccctggccaatgagccttggtcttgaacacttttggtcaggcgggtgggcgccggccttccgattacggctattttttttatccccttttttttatttttggggtgttttctcttttcctat

SEQ ID NO: 2102 - DNA, 960 bp, Arabidopsis thaliana
tggttcataccaaagtctgagctcttctttatatctctcttgtagtttcttattgggggtctttgttttgtttggttcttttagagtaagaagtttcttaaaaaaggatcaaaaatgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataagggaaaactcttcgaatactccactgattcttgtatggagaagatacttgaacgctatgagaggtactcttacgccgaaagacagcttattgcacctgagtccgacgtcaatacagactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcagaaccaaggccacaatatgcctccccctctgccaccgcagcagcaccaaatccagcatccttacatgctctctcatcagccatctccttttctcaacatgggtggtctgtatcaagaagatgatcctatggcaatgaggaggaatgatctcgaactgactcttgaacccgtttacaactgcaaccttggctgcttcgccgcatgaagcatttccatatatatatttgtaatcgtcaacaataaaaacagtttgccacatacatataaatagtggctaggc

SEQ ID NO: 2103 - DNA, 2481 bp, Arabidopsis thaliana
cataagtgaacacagaagaagcggtggctctgagccggcgaaatctcctttctcatccctaaaattttcatgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctagggaaccgagtgttgcagctgaggagggacatagccgtggatcttccaaagagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcagtctgttgatggtcagcacattatccttcacactttgaatgtgaagtgccttctgcatcactatggaagctatgactttcttccaccaagattgagtggaaagatactggaaatggaaaccattacccaatcagaagcgataaggagacgctaccgctttttaagtcatttttctttatcaactacacttcagatatgtgagattgatatgaaggaatccttgcctcctgatgcatttgctccatttatacatgaaattaagaagcgtgtgaagcagcggaaagaacgtgcttggaaggatcgaaaaaataaaatcaaagctgaagtagctgcagctgcagagcttgtaccattgatggccagttttgggcagtcgtcttctagtgatgactttcccccattttccttggatgactttgaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactgaaaaggcctatggatttgtgtatgtataataatcttttcatctaagaaaaactgagtaaagaaagaaccagagattatggtgagtgagtaagtg

SEQ ID NO: 2104 - DNA, 2617 bp, Arabidopsis thaliana
ttctgtgtgattcagttctcgatccatcttttcgtgaaaagtatcaatcttttaattctctagttgtttgtcaaatctggttagtttcttctcttgtatttatttgatgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgtacgacgtcgtcttcctctactactaatacttatctttttatacttaaacctaatttgtgttttggataggagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatctatgttcaaagagtgtccgcatccagacgagaaacaaagattagaactaagtaagagactttgcttagagacaagacaagtcaagttctggttccagaatcgtcgcactcagatgaagactcaattagagaggcatgagaacgcgttattgagacaagagaacgataagttaagagctgagaacatgtctattcgtgaagcaatgaggaatccaatctgcaccaattgtggtggacctgccatgcttggtgatgtctctcttgaagaacatcatctccgtatcgaaaacgctcgtttaaaagacgagcttgatcgtgtctgtaacctcaccggtaagttccttggccaccaccataatcaccactacaactcctccttagaactcgctgtcggcaccaacaacaacggtggacatttcgctttccctcctgatttcggcggtggtggtggttgcttacctccgcagcagcagcagtcgacggtgattaatgggattgatcagaagtcagttttgctggagctggctttaactgctatggatgagttagtgaagcttgctcagagtgaagaaccgttatgggtcaaaagcttggacggtgagagagacgagcttaaccaagatgagtacatgagaacattttcatctactaaaccaaccggtttagctactgaagcttctagaacctctggtatggtcatcatcaatagcttagctctcgtcgagactttaatggactccaatcggtggacggagatgttcccgtgtaacgtcgcaagagctacaaccaccgacgttatatccggtgggatggctggaacaataaatggtgcacttcaactgatgaatgcagagctacaagttttgtctccactggttccggttcgtaatgttaatttcctccggttctgcaaacagcacgcggagggtgtgtgggcggtggtggatgtatcaattgatcctgtcagggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatttcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcagggtgtctctctgctccgctccaatgcaatgaacgcgaatcagagtagtatgctaattcttcaggagacatgcattgacgcatctggagcgcttgtagtatacgcgcctgtcgacattcccgccatgcatgtggtgatgaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcggccgctttacaatgcgaaagctgatcttgatcaagactggcgcgtgcgtgtgtttc

SEQ ID NO: 2105 - DNA, 2243 bp, Arabidopsis thaliana
actatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcctctgcgtatgaacaaggaaagttttgtgacgtatttcaccaaagggcttctggatggaggtgttgtgagtcatgtggaaagcgaattcattgtggatgtattgcgtctgcttctgcttatacgttaatggatgctggaggaattgagtgtttggcttgcgcaagaaaaaagtttgctttgggacccaatttttcgccatcaccgtcctttcttttccagtctccaatttctgagaaattcaaggacttgtcgatcaactggagttcttcaactagatcaaatcagataagctaccagcctcctagttgtttagatccttcagttctgcagtttgattttcgtaatcgtggaggtaataatgaatttagtcaacctgcttctaaagaaagggtcactgcatgtaccatggagaaaaaaaggggaatgaatgacatgatagggaaattaatgagtgaaaactcgaaacattatagagtatctccttttccaaatgtcaatgtatatcacccactgatctcactaaaggagggtccatgtgggacacagcttgcgtttcctgtgccaattacaacaccaattgagaaaactggtcactctagactagatggaagtaatttatggcacacacgtaattcttctccgctaagtcgcttacacaatgacttgaatggtggagcagactcgccattcgaaagcaaaagtcgtaatgtgatggctcatcttgagacgccaggaaaatatcaggtggttccacgattttggcccaaggtttcatataaaaaccaagttctgcagaatcaatcaaaagaatctgaatccgttgtcactcctctctttgagaagatcctgagtgcaactgatactggaaagcggctggtcctgccaaagaaatatgcagaggctttcttgccccaactttcccacaccaaaggtgtgcctctcacagtacaggacccaatgggtaaagagtggagatttcagtttcgcttttggcccagcagcaaaggcagaatatatgttctagagggagtaactccattcatacagaccttgcagttgcaggctggtgatacagtcatattcagtcgattagatccagaaaggaagttaattttgggattcagaaaggcttcgattactcaatcgtctgatcaggctgatccggctgatatgcattcaccgtttgaagttaagaagtctgcttatataactaaagaaaccccaggagtagaatgttcctctggtaagaagaaaagcagcatgatgattacaagaagtaaacgtcaaaaagttgaaaagggagacgacaacttgctgaagctaacatgggaagaagctcaaggatttctcctgcctcctcccaacctcactccatctagagttgtgatagaggattacgagtttgaggagtatgagtttcagatcaacgtgcactgaagttgaaggactgttgatatcaccaacaaccacaaagcacccacgacatagagatggctgtacttgcatcatttgcatacaatccccaagtgggataggtcctaaacacgaccgatgctgttcttgtgcagtctgcgacactaacaaacgccgtaggcgttccctgttgctacggagggaaaagaagcagatggagaaagaagacaatgcgcgcaagttgctcgagcaactgaattctgataatggacttcaccaatctgctaacaacagtgagaatcatgagcgtcatgcttcgcctttgaaagttcaattagatttgaacttcaaaccagaaaaggacgaagaatctctccctggttctaacaaaactaccaagagcgagactctgcctcatgatgacacagtaaagtctagcttcacgtcaccaagctcatcaagtgctcatagccaaaataacaaggaagatgaaggaaaactcaagacaaccacagaaattgcagacaccaccaccacaagctccatgtagattttgcagactcttatagctgcaaggtgaatagattatgatgggaaa

SEQ ID NO: 2106 - DNA, 828 bp, Arabidopsis thaliana
tgttttggtaaattgaggaaatggaagagaggcataagtgcaagttatgttggaagagcttcgctaatggaagggctttgggaggtcacatgaggtctcacatgctcattcaccctctccccagtcagcccgagtcatattcgtcttccatggctgatccagggtttgttcttcaggacagagagagtgaaaccgagtcgtccaagaagccctcccgcaaacgatccagacttaaccggagatccatctcatcattacgtcatcaacaatccaacgaagaagggaaaagtgaaaccgcaagagcagcagatatcaagatcggggttcaagaactcagtgagtcgtgtacggagcaggaaccgatgagttcggtgtcggacgctgcaacaacggaagaagacgtggccttgagtctcatgttgctgtcgagagacaagtgggagaaggaggaagaggaaagtgatgaagagagatggaagaagaagaggaataagtggttcgagtgcgagacttgcgagaaagtgtttaagtcgtatcaggcgttagggggacacagagcaagccacaagaagaagatagcagaaacagatcaattaggctcagatgagttgaagaagaagaagaagagtactagtagtcaccatgaatgtccaatctgtgccaaagtcttcacatctggtcaagctctcggaggtcacaaaagatctcacgcttccgctaataatgaattcacgagaagatcaggaataataattagcttgatagatctaaatctcccagcgccatcggaggaggaagagatggcctcgtcggttttttaatgcttga

SEQ ID NO: 2107 - DNA, 840 bp, Arabidopsis thaliana
aaattcacaccattggcaggttttattcttactcatctgaatgtgtatggttaaaacagaacattgaaaagtactactgaaagttactatatgaacatgtaaatatagtttttgaagtgtttgaaggatgtctcttatgatcaacgctggcccaaacttctttcagtgtcctgagactatataagaagagctagagtccttagatttccaagatctgtaaattttgttttatatacttttgttcctgcatcttactgtttcgcttgatgtttggcaatcacctctagtttgaatcgatgcagaaagactgatgtaaccagctttgtctaccttttatagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggtttgtctgcttcttggtttttatatgaattgattgaactatcatggccctttcttcatcttataccttggcatttacaggacatcaaaacaggggaaatcacacgaagcttaccgaaatgtgatcatacgtttcatctggtatgtgttgataaatggctcatcagacacgggtcatgccccatttgcagacaggcagttaaagattaaaacacgactgttgccgagctgtgtacatagcaaaaacacattatccttatatgttgttgtaacttgtaagtctaaaacccctttcttctgtatttttcctcatttcatttagagcaatgctcagctaagggtg

SEQ ID NO: 2108 - DNA, 2629 bp, Arabidopsis thaliana
ccaatctttcgtttctgggtctgttgaaaaacgatgactgttgaacaaaatttagaagctttggatcagtttcctgtaggaatgagagttcttgctgttgatgatgaccaaacttgtctcaaaatccttgaatctctccttcgtcactgccaataccatggttcctctctctctctctctctctctctctctctctctgttttcttggatctgtttttcatcaagtttttagattttatgtctctttgatctgtgatttgatccacatatggtggaatcttttgatatctatctacctaacttcttgtatacacaaatctaaaaaaaacttagctttttttattccattgttagattttgtaagatttgacatttgtcagagagaaagtttcattgttgaattgaattaaaagtttaagactttatggaatctgttgcagtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataagtaagtcttattattattattattttctaattaaacttttgtcatttatttccttaatgactcactacaggaataaagttttgatctctagacttggttttgtgatgatgattttcttgttgttgcagtgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatcagaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagagtaagcttatcaatatgtcacttgatatgagagtaagcttatcagtatgtcacttaagttctgttttgtgtgtgttgttttgattgcagaggctatgcctaaaaagattttggatctgatgaatgttgagaagctcactagagaaaatgtggccagtcatcttcaggttacaaagaatctttcatgtttttaacttgcgtaacccgaagatttgttttttaacacctcggaagcttatgactttgttcgctgtggtttgcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatactccttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtgacattaaagcttttgccaatattaaccattctgatttggagattattgtgatttctgacatgaagattttgtgaatgtgacaggaacagagccagggagatttgtctggaggagatttgggatatggagggtttagttcactcagaacatgcatatgagagaacaaacatttagacataaatcaaatatcatcatcttgtttgtctctttttctcgctaatcttttgtgtattaaaattgtaaactatttgttttcccactggttctagcaatttaggactc

SEQ ID NO: 2109 - DNA, 3008 bp, Arabidopsis thaliana
ctctgtagctccttttcctctcagcagccatggaagaaaaaactcatcatcatcatcacagtaccaacaaacacatccctagttccaaatcaagaacacctcttctccacaagccttatcatcaccatgttcaaaccaatcctcctccttttcttttgcacccttcttctcaccaaaacctcaatcttgttgcctcaaatcttccttctagctactactactattactactgctacttctactctcaatttcacaactctcttcctcctcctcctcctcctcatcttcttcctctttctcctcctcttcctcctttacttcctcttcctcctcctcactcaatgacccgtttccacaaatctctccctgtttctcaagttgtggagagaaagcagcaacaccaacagaagaagaagatacaagtttctaacaacaaagtgagtggatccatagcaatagaagaagcagcattagtggttgctaaaagaccggactttggtggtcaagatggttctgtcatttatctcctcgccaaccattttcttgtcaagtttgattcgtcacagaggatttaccattacaatgttgagatatctccacagccttcaaaggaaattgctagaatgatcaaacagaagcttgttgagacagatcgtaatagcttctctggtgttgttccggcttttgacggcaggcaaaacatttacagccctgtggagtttcagggagataggcttgagttctttgttaatctccctatcccatcttgcaaggctgtgatgaattacggtgacttgcgtgagaagcaacctcagaagaagattgagaaactgtttagggttaatatgaagcttgtgtccaagtttgatggtaaagaacagagaaaggaaggagaggattgggctcctctgcctccagaatacattcatgctcttgatgttatcttgagagagaatccaatggagaagtgtacatcgatcggaagatcgttttactcgagttctatgggtggatctaaggagattggaggaggagctgttggactcagagggtttttccagagtcttagacatactcagcaaggtttagcacttaacatggatctctcaatcacagctttccatgaaagtattggagtaatagcttacttgcagaagcggctcgagtttcttacggaccttcctaggaacaaaggtagagaattgagtttagaggaaaagagagaagtggagaaagcacttaagaacataagagtctttgtttgccatagagaaacagttcaaaggtatcgagtttatgggttaacagaggaaattacggagaatatatggtttcctgatagagaagggaaatatctaaggcttatgagttacttcaaagatcattatggttatgagattcagttcaagaacttgccgtgtctgcaaatcagtagggcaagaccttgttaccttcctatggagctatgcatgatttgtggaggtcaaaagtttcttggaaagctatcagatgatcaagctgcaaagatcatgaaaatgggctgccaaaaacctaatgaaaggaaagctattattgatatggttatgacaggatcggtcggtccatcgagcggaaaccaaacaagagaattcaaccttgaggtttcaagagaaatgacattgctgaaaggaagaatacttcagccaccaaagcttaaacttgaccggccaaggaaccttaaagaaagtaaagtttttaaaggaactagaattgagagatgggctttgatgagtattggaggcagctctgatcagaaatctaccattcccaagttcataaacgagcttactcaaaagtgtgagcatttgggagtcttcttaagcaagaacacattaagcagtaccttctttgaaccatcacacatactcaacaacatttcgcttctcgaatcaaaactgaaggagattcaaagagcggcatcgaacaatctccagctgattatttgtgtaatggagaaaaaacataaagggtacggagatctaaagaggatatcagagacaagaattggtgttgtgacacaatgctgcttataccctaacatcactaagctcagttctcagttcgtttcgaacttagctctcaagataaacgccaagatcggtggatccatgaccgagctctacaactcgataccttctcacatccctagactgcttagacccgatgagccggttatcttcatgggagctgatgtaacgcatcctcatccattcgatgattgtagcccttcagtagcggctgtggtagggagcataaactggccagaagctaaccgatacgtctcaagaatgaggtctcagactcataggcaagagatcatacaagatcttgacttgatggtcaaggaacttcttgatgatttttacaaagcggtaaaaaagcttccgaatcgaatcatattcttcagggacggtgttagcgagacacagttcaagaaagttctccaagaagagcttcaatcgataaaaactgcttgttcgaagttccaagattacaatccaagcatcacattcgccgtggttcagaaaagacaccacacaaggctgttccggtgcgatccagaccatgagaacatacctcctggtacagtggttgatacagtgataactcatccgaaagagtttgatttttatctctgtagccatttaggagtgaagggcacgagcaggccaacgcattaccatattctatgggacgagaacgagttcacttcagacgaattgcagagacttgtgtataatttgtgttacactttcgtgaggtgcacgaaacctatatcgattgtgccaccggcttattatgctcaccttgctgcgtacagaggaaggctatacatcgagagatcatctgaatctaatggaggatccatgaatccttcttctgtgtctcgtgttggtcctccaaagacgattcctcttcctaaattaagtgataatgtcaagaatctcatgttttactgctgattcttt

SEQ ID NO: 2110 - DNA, 1897 bp, Arabidopsis thaliana
gagttgagagccatactttcactataccagttgcttcctcagatatgccatcggctgaagaaagtgacaatgtctggtctttaatacctcagcttaagagaaaactgcatttgcaccagaaaaaagcttttgagtttctctggaagaacctagccgggtcagtggttcccgcgatgatggatccgagttcagataagataggtgggtgtgtagtttctcatactcccggagcaggaaaaacatttctaatcatagcttttctcgcgagctacttgaagatatttccgggtaaaagacctttggttcttgctccaaaaacaactttgtacacttggtacaaggagttcatcaaatgggagattccggtccctgttcacttgctccatggtcgtagaacctactgtatgtccaaagagaagaccattcagttcgagggaattccaaaaccaagccaagatgttatgcatgttcttgactgtttagacaaaatccagaaatggcatgcacagccgagtgttcttgtaatgggttacacatcgtttctaactttgatgagggaagattcaaagtttgctcatagaaagtacatggctaaagtactgagagagtctcctggattactggttctagacgagggacataacccgaggagtaccaagtcgagattacgaaaggccttgatgaaagttgatactgacttgaggattctgctttctggtacattgtttcagaacaacttctgtgagtacttcaacactttgtgcttggctagacccaagtttgttcatgaggttctagtggagttggacaagaagttccagaccaaccaagccgagcaaaaggcgcctcacttgcttgaaaatagagctcggaagttcttccttgacattatagccaagaagattgacacaaaagtgggcgatgagcgcttgcagggtctcaacatgttgaggaatatgacgagtggtttcatcgataactatgaagggagtggaagcggaagtggtgatgttctcccaggtttgcagatttacacattgttgatgaattccactgatgtacagcacaagagtcttaccaaacttcagaacataatgtcaacttaccatggatatccactcgagctcgagttactcataacgttagctgctatccatccttggttggtcaaaaccacaacctgttgcgccaaattcttcaaccctcaggagcttttagagattgagaagctcaagcacgatgcaaagaaaggatcaaaagtcatgtttgtgcttaatcttgtgttccgggtggtcaagagggagaaaatcctcatattttgtcacaacattgcgccgatccgcctgtttcttgagctgttcgagaatgtattcaggtggaagagaggccgagagctcctgaccttgacaggggatctcgagctgtttgaaagaggcagagtaatagacaaatttgaagagccaggaggccagtcccgtgttctgctggcttcgattacagcctgtgcagaaggcatcagtctaaccgctgcttcacgggtgatcatgcttgattcagagtggaatccttctaagacaaagcaagcaatcgcacgtgcattcagaccgggacagcagaaagtggtgtacgtttaccagctcttgtcgagaggaacacttgaagaagacaaatacaggaggacgacctggaaagaatgggtctccagtatgattttcagtgaagaatttgtggaggacccatctcaatggcaagctgagaagattgaggacgatgttcttagagaaatcgtggaggaagacaaagtcaaatccttccatatgatcatgaagaacgagaaagcttcaacaggtggctgattgctgaatttttccagttcaagtttctgtttcaccatgcc

SEQ ID NO: 2111 - DNA, 1126 bp, Arabidopsis thaliana
ttcacaaccgagattctgaacaactaaaaaacaaaacttatcagaagaacaacactttagcaatcatttaactcgctgtagaaatcaggcgtaaggaaagaatctaaatcaccgaagataacatcatcttcctccgccgttaacttgccggagttttgacacccgaaatacgtctggatatcttccgggaagctccgacgaggcggagcaatctcaggtggcgtcgatggtccgattacctcctctgccactaaaggtgacgacttcaagagctttgttttccgatcatcgttgtcctctgacgaagattgactctgtgataagtcagactcgtggttaggttttataaatgggctaagatcagaatgcggactctcgaggagattattcgcggtatcgatagggttctccggcaccgggagtttcagataacggctgatgtcgaagttagtaacggcgttgagtccacggtactcgatagctgcgatatcgtacgctatagctgcttcttcttgcgtcgcgtaagttccaaggtataaatatttattgccaaacactcttccgattcgagcttcccatctcccattgtggtgatgctttgcaacgcctctgtattttgatacacctcgtgaaaacccactactttttcttctcaaagatccaatatactcttcctttgactggctttccatttctttgatgtcttcttcataattacacaataggattccgagaaaatttacagggaagttcaagatggtgtctcgtccccaatatttcaatgctgctaagtcgtaggcacgtgctgctgcatcttcctcgtcatatgcccctaaatatacttgtcttcctttcttggtctgagtttcgttccaactattcttatcccacaaatgtgcttcgtaccttccagtccatcgatgccttgtgacgcctctatggacggagctacgttggggtggagcgtctcgtggttgcgatcggcgtttgcgtttagctttaaggactactgatgttgctgactgatcatcgccggtttcattctcaaccgaagtttttttgctctgccgtgtgatgtcttccattaccggagaaacttcgacggcgatgaacataaaagaagagg

SEQ ID NO: 2112 - DNA, 757 bp, Arabidopsis thaliana
tctctctctgcattctctcttacacctgtctttatctgaaaaataaccgatgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtaataatttatctctgtttctctgtttttagagacttcaaatttcttagtttgctgctgatttctgagtttagttagttatagactgaacaaacagaggaaagtttatgttacttagcttaggtctagtagtaacttagctataaaaaatctgcttagctaaaaagatctgcttcttggagcacttcaactgtaataaatttatagttgtgttgactttttgaaagtgttattgatgtaactaggacctgattctgctgatactactactcctctatgttccttaggtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgg

SEQ ID NO: 2113 - DNA, 1761 bp, Arabidopsis thaliana
cctatcattcatcgtacacacacactctctatgacaaagctccccacaacactcaaccatctatttgatctgccggggcagatttgccatgtccagtgtggtttttgcaccactattttgctggtataccttaacttcttctcttattctctcccttcctttctcccttcctctctttatatatatgatcatgagtttaatgagtgtaaatgtgttgcaggtgagtgtaccgtttacaagcttgtcaatggtggtgactgtgagatgtgggcattgcacaagccttctctctgtcaatttgatgaaggcttccttcattcctctccatctccttgcttctctctcccatcttgatgaggtttccataacatctatacatagacaaacacacaccatctaaatatgaccaatatatatatatatatacttacttttgattatatgtaaatatatgtgcagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaacgtacgtttgagtataaattcaacttaaactttagttttgcgatttctcctttcatcagtcgtctaattatgttttgagtttgtatatatatagcacctgagaagcgacaaagagctccttcagcttacaattgcttcatcaagtaagaaataaattcaacacattacatgtgtatgtatattatatatattcttacaaatttaaccacttaaggttttgagtttgtaaaatggttcttctttgggggttgtattggagcagggaagagatcaggaggttaaaggctcagaatccaagcatggctcacaaggaagctttcagcttagctgccaaaaatgtacttaagcttaattagtcttaagatttaaaagaaaaccctaatatagttttcatctttttgttagcttaattgacagatcgagttagctaataacattttatgatttcaattttttgatttggggatggcgaagtgggcccattttcctccagctcacaacaagagagctgcttcagatcaatgtttttgtgaggaagataacaatgcgatactaccatgcaatgtttttgaggtaatcctcagcaaccatttatattttttaatcactttcgcttcaaaatcaattaccatattcttgacaagtaaactccacaacaagtgtcattttccaaagcaaaccaaataattaaagcattaactagatccaaatagcatcgctctcagtcaaaatttcagaaccctagctagactaattatataaagagaaatcatttactaattattagagtgaaagcaaggagaagggtaagtgagattgtgagaatatatcattgatcttcaactactacaatgtgtgaaatttatgacctaaacccttttatagtattgaagcttacactgcacacagtttacttttatagaaacccattcaactaatttaaaacattgaagctgaatatgtatagttttcaattaatataccaaataattgttgaaatgtttgtgatgcaggaccatgaagaaagcaataatgggttccgagagagaaaggctcagaggcattccatttggggaaaatctccatttgagtaataacaatttgggatatgaaaatttaacaaaaaaataaataatggcgtatgacatgtga

SEQ ID NO: 2114 - DNA, 1773 bp, Arabidopsis thaliana
gtcaccatcacatgtcatacgccattatttatttttttgttaaattttcatatcccaaattgttattactcaaatggagattttccccaaatggaatgcctctgagcctttctctctcggaacccattattgctttcttcatggtcctgcatcacaaacatttcaacaattatttggtatattaattgaaaactatacatattcagcttcaatgttttaaattagttgaatgggtttctataaaagtaaactgtgtgcagtgtaagcttcaatactataaaagggtttaggtcataaatttcacacattgtagtagttgaagatcaatgatatattctcacaatctcacttacccttctccttgctttcactctaataattagtaaatgatttctctttatataattagtctagctagggttctgaaattttgactgagagcgatgctatttggatctagttaatgctttaattatttggtttgctttggaaaatgacacttgttgtggagtttacttgtcaagaatatggtaattgattttgaagcgaaagtgattaaaaaatataaatggttgctgaggattacctcaaaaacattgcatggtagtatcgcattgttatcttcctcacaaaaacattgatctgaagcagctctcttgttgtgagctggaggaaaatgggcccacttcgccatccccaaatcaaaaaattgaaatcataaaatgttattagctaactcgatctgtcaattaagctaacaaaaagatgaaaactatattagggttttcttttaaatcttaagactaattaagcttaagtacatttttggcagctaagctgaaagcttccttgtgagccatgcttggattctgagcctttaacctcctgatctcttccctgctccaatacaacccccaaagaagaaccattttacaaactcaaaaccttaagtggttaaatttgtaagaatatatataatatacatacacatgtaatgtgttgaatttatttcttacttgatgaagcaattgtaagctgaaggagctctttgtcgcttctcaggtgctatatatatacaaactcaaaacataattagacgactgatgaaaggagaaatcgcaaaactaaagtttaagttgaatttatactcaaacgtacgtttattgacaacttggtaaacacgagacacatcttcatcttcattgtctgaagatgaaaccaaagtcgttggactgttctccttctcctgattcaccttccatgcttcttcttccacaccatctgtagctgcaacctcctctttcccggtctgcacatatatttacatataatcaaaagtaagtatatatatatatatattggtcatatttagatggtgtgtgtttgtctatgtatagatgttatggaaacctcatcaagatgggagagagaagcaaggagatggagaggaatgaaggaagccttcatcaaattgacagagagaaggcttgtgcaatgcccacatctcacagtcaccaccattgacaagcttgtaaacggtacactcacctgcaacacatttacactcattaaactcatgatcatatatataaagagaggaagggagaaaggaagggagagaataagagaagaagttaaggtataccagcaaaatagtggtgcaaaaaccacactggacatggcaaatctgccccggcagatcaaatagatggttgagtgttgtcgtcatgttggggagctttgtcatagagagtgtgtgtgtacgatgaatga

SEQ ID NO: 2115 - DNA, 636 bp, Arabidopsis thaliana
gataattcatggtgtgtgtgtatgaagatgctgttttggttagactcgagcaagataagaggatatctctaatcaaagcttgggaagaggctgagaaatccaaagtggagaacaagtgagtcctaaagaagtttatataatccattgttttgatgaatttccaaatttttagttccatgatatttttttttgtgttccctatatatttgtatgtaatctcatttattaactttatgaaacagagctcagaagaagatttcttcagttggagcttgggaaaacagcaagaaagcttctgtggaagctgagctaaaaaagatcgaggtaaaagtgtaattctttattctttcaattttgttgttttatttttaacttttacatgaaatgctttccacttttcacattattctaatttatccgctggaaatatgaatgataacaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctg

SEQ ID NO: 2116 - DNA, 1014 bp, Arabidopsis thaliana
ggtcatatatggctggtggtatcggaaaatggcaggatttttctcgttaggacacggcggaggaggaaacactccagacaaccacagaacaaacactaataatccttcttcatcgggaacagaatcttggctttggtgcagaaaccctaactctaacgctgacggtggagaagctggtccttcttacaaaggaacccttgagctatggcaacacccaaacaatcaagaaatcattttccagcagcagcagcaacagcaacaaaggctggatctttacacttccgctgcgggtttaggtgttggaccgagcaaccggagcttaattgaaacttccggcggtgcgttgatgatgatgagaagcggtagcggtagcggcggaccaagctgccaggattgtgggaatcaatctaagaaagactgctctcacatgagatgtaggacttgctgcaagagccgtggccttgactgtcccactcacgtgaagagcacgtgggttcctgccgctaaacgccgagaacgccagcagcagctttctaccggtcagcaaccgcagcaactgggagggagcgtccctaaacgacagagagagcgtatcccggcgagatcgacttccatggcctacactcgtataccttctaacaacacttcagggttggaggttgggaattttccgccggaagttagctcgtcggcagtttttcggtgcgtgcgtgtgagttccgtagatgatgaagaagaagagtatgcatataaaacagctgtgagtataggcggtcacgtcttcaaaggtgttctctacgatcaaggcccggccgagagaagctcctcgggcggtggatctcagccgttgaatctcataaccgcaggcccatcggcctcatcatcaagcccaaacgtgagctgcaacaatggagtcgttggctccacttcagatcattatatcgatcctgcctcacttaattatcctactcccattaacactttcatgactggtacgcacttcttctccaactc

SEQ ID NO: 2117 - DNA, 1458 bp, Arabidopsis thaliana
agaagaagaagagagagctattcaagcttaaagcataaaacaatctctgctccttatatagttcttcactatggaagatttgagtaatcagaatctcctcccgcgtcaatcagatatctccatccctgcggagaagatggattcgtttcaaaagtcgctagaacctccgccgtgttctccggtgaaatcttctcaacaatcagaaacggaagtcacaccgcctcagaaaccaccgcttcaccaatttggtcacaaccaagttcagaagaatcgagtgagcaatcaagatccatcgacctcacgaagacataatgaagttgaatcgaaagagaatactccaaataaacaacaaaaacattgcaattgcaaaaactcaaagtgtttgaaactgtattgtgaatgctttgcttctggatcttattgtaatggttgtaactgtgtgaattgtcacaacaaattggagaatgagtcttcgagacaagtagctatctcggggatcttagagcgtaaccctgatgcgtttaagcccaagattgctggtagtcctcatggaatgaaagatttgcaggagaatgtgcagcaagtgttgcttattggaaagcacagcaaaggatgccactgcaggaaatcaggatgtctcaagaagtactgtgagtgttaccaggcgaatattctatgttcggagaattgtagatgtcaagactgcaagaactttgaaggaagcgaagaaagaaaagctcttcttcatggatctcaggtctcggatacctacatacaacagatgaccaatgcggctgttaaccgtgccatcgacatgtctgcttatctgtaccctcctgaatcaagaaagagaaagagcaaggacatttcagattctgtagtttcatcatacggtgtccaataccagagggcaaaccacgttagaagaaatggtgaaaattctctattttcactccctaacaacaaggccgtgtccggatctaccacaagtgcttacaggtcttcttggtcaaatacattccaaccacatcatgtcagagagctatgttcacttttggtctcaaactcggtgatgtagcaaataaattgtcagacaaagggaggaagaacgacaaaggcccttcttcacttgatggagcccaaagagttgctaatgagatcaatgactcaccagattgtgtccttgatgctaatagaatggacgagaagcctatatctcccgcaacacgtgcattgatgtgtgacgaagaacatgagatcgggtcagagaaagagacatcggcccgagtgaaaacaagccaagagaaagaagacacagacacaagctcggggatttacttagagcaagaaagacagatattgtcaatcttcagggactatctcattcagctctcaaaccgtgcgaggataaatggtaaaaatatcaaaagcaacacaaatccaagttgaaagaaacca

SEQ ID NO: 2118 - DNA, 4053 bp, Arabidopsis thaliana
gctacacgcgtggagtttccttctgtgaagtcgaatcagcgaagtaaaaattgaatctttagggttttcttagtttgtatttacctttttgttttggaaatcaaatctctggcctcgtttttttttttaataatccggaggccttgattagggttttcaaaatctagtagctttgtgtcatgatctttataagataagtaatagatatatgtatttttttgctttttatatcagatacaaattttcaatggcaatttattacaagtttaagagtgcaagggattatgataccattgccatggatggtccttttatatccgtcggtattctcaaagacaaaattttcgaaactaagcatttgggcactggtaaagaccttgatattgtcgtctccaatgcccaaactaacgaaggtttgtcttctatgtcaaatgttgtgctgcgcttttcgtattattagactgtttgcttgcagctgtgatacaatgaactttattttatgttatgattgtttactagctgagctttgtcttattttttttttacttttgtgaactattaggaaatggtttgttggaatatgattcttgaatttctcaggaagctttagtgtactgtgtctcgtgccaatatgattgcaatctgtggcctttatatgttctctgttttgaattttcagagtatctggatgaagcaatgttaatcccaaagaatacatctgtccttattcgtcgggttcctggacgtcctcgcatcacagttattaccacacaagagtactttctcagatctttagtttctatattctttgtctacttatttagctattaaacttaaatagacatgatattaaaagcattgcattttactggtgcatcgttttagctaaacataagttaattgtctgactatcggatttaagaaacttcgggatcctcaatgatgcaaatatcttaactttgcaggcctagaatccagaataaagtggaagacgttcaggctgaaaccaccaattttcctgttgctgatccatctgctgctgaatttgtaagttgattatagtgaacttttctcggcttctgttggcattgactgcacctaattttcttctactacaaaagtactaatgtcatccgtattcacctcttagcctgaagatgagtatgacgagtttgggactgatctttattccattcctgatacccaagatgcccagcatattattccacgtcctcatcttgcaaccgcagacgacaaagtagatgaagaaagcaaaattcaggcgctgattgacactccagcacttgactggcaacaacggtaagcaatcttccagaaatggtgcaggtgaaactgttggattttgtgagaaggtttaacagacctcttatatttattcaatgtaacagacaaggtcaagatacttttggagctggtagaggttatgggaggggtatgcctggaaggatgaatggacgtggttttggtaacttatacttacttttattctttgattttggttgaattctggaatgtcaaaatacagtatacaaaacatttacttctgtcaaaatattttatatttttgttctatttgctcaagttgtaagatacttagtttggttttgctggctggataggaatggaaaggaaaacgccacctccaggttatgtgtgccatcgttgcaatatccctggtatgtcagctctgaaaatctttatttttctctcacttttgtagatggatatataatagataagaagtgttgagagcattttctttgctgtctcaggacattttattcagcattgccccacaaatggagaccctaactatgatgttaagagagttaagccacctactggtatccccaagtccatgttgatggcgaccccagatggttcttattccttgccaagtggcgcagttgcagttctgaaaccaaatgagtaagttgtactgaattagtttgggaatgttgctattgggtacttcttcacatatattgattatagtttaaatgtttgttgtgtcttcaacaaattcagggatgcttttgagaaggaaatggagggattgccatcaacaacacgttctgtaggagaacttccacctgagctaaaatgcccattatgcaaagaagtgatgaaagatgctgcgcttacaagcaaatgttgttacaagagcttctgtgacaagtgtaagttcttttaatgcattctgctgttccacaaaaaccttttctgaccgttgtcagttccagttctacattattatcctttttcactgattcaggtatcagagatcacattatttcaaagtcaatgtgtgtttgtggaagatcagatgtacttgctgacgaccttctaccaaacaagaccctcagggataccataaaccgtattttggaagctggaaacgatagcactgagaatgtgggcagcgttggccatatcccaggtccgtcattattttaaattcatgtgtttttaaactttgtttgattagtcctcactactgaattatcatggacaatatagatttggagtctgcacgctgtccacctcccaaggctctatctcctactacatctgttgcatctaaaggcgagaagaaaccagtacttagtaacaataatgatgcttcaactttaaaggcgccaatggaagttgcagagatcacaagtgcccctcgtgcatctgcagaagtgaatgtagaaaagccagttgatgcatgtgaaagcactcaagggtccgtgattgtgaaagaagcaacagtgtcaaagttgaatacgcaagcccccaaggaagaaatgcagcagcaggttgctgctggagagccaggtaaaataaagatgtactaatattagcttcactggacattgcgaatgattggtgactgatagtccagttcagatttccctactgagattaatcaagctggacctcacatgaaccttttttttttcaattactgaggaacccttgttgtcattcatcaatgtaatacgtacttattgtctctatacaggaaaaaagaagaaaaagaaaccaagagtgcctgggaatggtaaaagctttctttgctacgctgaaggcaatacattgtcagtttcgaagtctatgtgaatcgaatgggaggtctaaaagatggtttgtttatgtgatttattgcagacatgcaatggaatcctgtgccagatctagcaggccctgactatatgatgcaaatgggaccaggtccgcagtacttcaacggcatgcaacctggcttcaatggcgtacaaccaggcttcaacggtgttcaacctggcttcaatggctttcaccctggcttcaatggatttggaggcccgtttccaggcgcaatgcctccatttatgggttacggattaaacccaatggacatgggatttggtgggggtatgaatatgatgcatccagatccattcatggcacaaggatttgggttccctaatataccaccaccccataggtaaaacactcactctatcaaagaagagcaataaagctttctcaacaagtctcatgatggaactttctgtgcatgcgcagggacctagctgaaatgggaaaccgaatgaatctccaacgtgctatgatgggcagagatgaagccgaagcccgaaacgctgagatgttaagaaaacgtgaaaacgagagacgacctgaagggtaaaaagaaaacactcactctatttttactacagattcaaacaaggatatgctaaaacctaaacattggttgttgtttggttgtatatacagtgggaagatgtttagggatggagagaatagcagaatgatgatgaacaacggtacttcagcctctgcatcatccatcaaccctaataaatctgtatgtctccttttgtttgactcatcttcccctctcgctctctctttcttcttttctttgttcacctgtgcttcgctctctcccatttacttttggttatatgttattattatatcagaaaatggctccaaattctcttccctgattccctcattttgcttattttgaaaacc

SEQ ID NO: 2119 - DNA, 2267 bp, Arabidopsis thaliana
ctcaagctatgaacttccatactttgaatcttctacttctctttcttcctcttacttgatcttcctatagcatacttccatcatgtaagttcctttttgtatttttatttctcttacttgctaaagttttatcttcacattttttgatgattagggttttggtttgagattaggggtgaagatgatatagtggagctcttatggaacggccaagtcgttcgaaccagccaaccacaaagaccttcctcgggtaaaccttctcctactccacccattctgcgtggtagcggaagcggcagcggagaagaaaatgctccccttccacttccacttctacaacctccacgtcccctgcatcatcagaatctcttcattcgggaagaagaaatgtcttcttggcttcactattcttacactggtgtcacgtccacaccggctactcatccgcaaagttctgtttccctgccaccaccaccacccattgctccgtacatttccgttctttttcctttcattctcttactctttgcaatttgacgagtctgatattttagggtttggattttggtttgaaattaggagtgaagatgatgtggtggaactcttatggaaaagcggccaagtcgttcaaagcatccagacacagagacccattcctcctcccattttccgcggcagcggaagtgggggaggtgaagaaactgttctgcctctgcctcccctgcatccgtctcatcaaaatatcttcatccaggaagacgaaatggcctcttggctttaccatcccctccgtcaagattatttttcctctggcgtcgcctctacttcagctactcgcccgcaaagttccgcctctctagcaccaacaccaccaccacccagtgttccctacggtcagattcccgttgagagaaggacagagaattttatgaacttcttgaggctaagagggaacatattttccggcggtagagttgaagctggtccggtggttatagaatcgacgcagataggctcaagcgcgaccccgtcgtcttcagccgctgaatcctgtgtaataccagcgactcacggcaccgagagtagagcggcggccattaccggagtatcccgtacttttgcagttcctggtcttggtcggaggggaaaggaggtggcaaccgagacggccggaacatcatattcaggggtaaacaaggccgaaacagagcgggttcaaatacaaccggagagggagacgaaaattaccgaagataagaagagagaagaaaccattgcagaaatccaagtgagtcacagctaccataggttcacctgttgacacgtgcagtgtagcagtcaaggcttaattttatcttgtttcttggcgtacagggaactgaagaagctcatggttcaacgtctaggaagaggtcacgagctgcagatatgcataacctctccgaaagggttcttatattttactttctaggttttaataatggactctttgtttcgtctctccattaaaacgtagtttgtataattgtttaacagagacggagggaaaggatcaacgagaggatgaaaactctgcaagaactccttcctcgctgcagaaaggtctctctcagttatttataacctgtggctgttaaacataaaaaaagttagattctgatgacatctgtttctattctgatcagactgataaagtttcaatgcttgaagatgttatcgagtacgtgaaatcgctacagctgcaaatacaggcatgtactcaaaaactgaatgtgtgttaaagcaaaacacaaccggaaattaagtgctgtggaatagttgaacatggttatttgagtgctatggaatggttatactctttgtttatcaaccagcgtctctgcattttaaacaaccaattttttagatttgatttctgcagattcatcttggaagggttttaaagtgtcatggaagataaatgcaaatcttataagtcatgttcttgaggtcttactcttctgtattgcttcacacgtttacaggattatgttgaagaatctacagcttataactgagattttaatatatgaatcaatgttgttatgccagatgatgtcgatgggacatggtatgatgccaccgatgatgcatgaggggaatacgcaacagttcatgccccacatggccatggggatgaagggtatgaaccggcctcctcctttcgtaccgttccccggcaaaacttttcctaggccgggtcatatggcgggtgtaggtccatcata

SEQ ID NO: 2120 - DNA, 1545 bp, Arabidopsis thaliana
tctcaaagtcataatcttcgaatccaaaaacaaaaaaaaacaatggaactatcattagcattaacatcaacagaccataatccatcgccttcagaggcacatccagatactatggactttctgtctcgagaatggtgtaatttcgctgttcaatcacttcatccagaccctatcctctacgatcgttccattgttcccgtcgagacatcgatcgccaagtttcaaggcgactcaagtcctgtttcttgtgctgtaagtaaccagagattgttttttgttatattttcttcaattttgttggttagtgtttaatttatgatgattgtaaaagtagatgatggatacgagcatgaagatggacgatccagattttaagccctcgatgccttcatggaaaaccaatgatgtgaaggtataacaaattaggtgtgcaaaatatagtttttaaaataacaaaaatcacagtaacgtttaacattatgatatcatagttttcaacatatattcctcatttttatgttgtctatgtttatttgatgcacattcgaatgaaaattcggtatatatatgatttaaattgtaatacgacagcatattggaattgtagaaattgaaaataaaactgctacatgatagaatgacatatacaattaagtgaagaaagttaagagattaaatattgatactataatttgttgaatgatgtgaacagtcatggatatggatgcaacaagcaatgcacccggaattgagctacgaaggctttttccgcaagaaacttgtaaaacccttttggccatttcgtttggttttgatttatcaaatcaacaatattggttttctaaaccaaaacaataatggttttgtagaaacttccatggaaaattacgccgtcgataaagaaatggtggaaagagataaaggcgaaacgaaaggaagaagtgaggctacagagagctgaagtccacgccgccgtgtcattggctggtcttgccgctgctctcgccgccgtggcttcagagaacgctggaaaagatggtggaaacggtcgacctagcacgagggagactgctgtggcttctgctgcggctgtggtggcggcacaatgtgcgcaaatggcagagacaatgggagcaaacagagaccagctcagcacgatgattggttcagccatgaccgggacaagtgttagtgagatactcactctcactgcctcagctacaacttgtaagaagattgttttttgtttttgtttctataagaatgctctgtttctgagacattggtgcttggtaaaataagcgttgagaggtgccgcgacgctgaaagcaagaagaggttgcaagattaatagattgaatggctctgcacctgtgttgcctattgaagactcttcttatttgcctcctgaattcgataagaacacatctgttcttgctaagggaacagatctcttcgtcgagacaccagatggtatataaatcctctgtttttcttgttgaactcctttgttttgtagagagactaaagagatctttggattaa

SEQ ID NO: 2121 - DNA, 1568 bp, Arabidopsis thaliana
gtcgacaagatcatcagactggaaaatggcacaattacccatgatgatcttggttgtcagaagagtcaggggctggccaaaacgttgagtacttcaaccattctgcttcttgttggttccccattgatgatgacccatcttttacatcatgatgagtggtagaagaagtgcagcccattatgagttcttccaatccggaagctgaccttcctcccatcttcccatcattatgttcttcttctccttcttgacgtagttgctgttgtgtctggtaattttcattggggagcaagattctatgaacatgataaggattatcgtcaagaatattaatggaggcatggtgaagcgaagtagatggagaaataatggttgatatcggatgtgtaggctggcttatgttgaatgcatgatgccgttgttgttgttgttgatgatgatgatggtgatgatcatgagccatatgatgtgatgttgatgatgatggttgatgacgatgacgatgttgttctgccattacatcctcacatgtagcgtgcccagtctgaggagtttccctcctcgccacctcatcaaagcttttcataaacggaacaaagctgagctgatccattgcataactcggaagcccagctgcaaccgccgcagccgcagctgctacggccataacgccaccaccaacgccgcctatttcatcggatcgattcggaggattaacattaataatttctctagacgaagaacaactcccaccactagtagtcccactatctctcctcatatgatactctccgccgcctccgccgctactcgcttcaccgccgccaccacctatagcgttcaagctcgatgtagaagacgaccagttgcattgcctaggctgagtttgataaaagatcttagacacaacaagttctccttctttctcttcctcatgtgtccccaaatgatattgatgcattacccaattggttttctccggttttcgattcttaccaaaattggtatacaaaaccaaaatcttcttacaacctttttgcttaccgtttaccataaccggtcttgtcttaccggtcttatgccacctcgtctcaccggagctactacttccttgcaaattattgtcacattctgtttgaatctttcttcgctttcttgttcccgtcgtgtacgcctttgatggtctatgaaagaagtgtcggcttaaaccatctctagtcactccaggaagtttctcgggatgagtgtagcaaatgccgtcttcgccttcaatggttgggatgaattcgtcaatgagagggtgagatttgaagtctttagctaacactttcgcttctaaatgttctatcaattcttgatccgttgggtcaaatttcactcctgctggtaaaccaacccaatcctgttactggtttgccttcgagcttgtggccgcagctaggacacttcttggatccacaaagttgatgttcttcgatcttggcgtctattatatccgaaccagtcaccgaaccagcaggattactcttgttcatctcaatctcgaatatctttgatcaactctctct

SEQ ID NO: 2122 - DNA, 3318 bp, Arabidopsis thaliana
tcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatctatggcggaagcaagacgattcagcccagttcatgaattagatgttggacaaatactctcagaagcacgacatcgatggcttcgtcctcctgaaatctgtgaaattttacagaattaccaaagatttcaaatttctactgagccacctactacaccatcaagtgggtctgtttttatgtttgatcgaaaggtgctcagatacttcaggaaagacggtcacaattggaggaagaaaaaagatggaaagactgtgaaggaagctcatgagaggttgaaggcgggaagcgttgatgttctacattgttactatgcgcatggacaggacaatgaaaactttcaaagacgcagttactggttgcttcaggaagaactttcccacatagtttttgttcactacctcgaagttaagggtagtagagtttctacttcttttaaccggatgcaaaggactgaagacgcggctcggtctcctcaagaaactggggacgccttgaccagtgaacatgatggttatgcttcttgcagcttcaatcaaaatgatcatagcaatcattcacaaactactgactcagcaagtgtcaatggttttcactctccagaacttgaagatgctgaatcagcatacaatcagcatggaagttccacagcttactctcatcaagaacttcagcagcctgcaacaggaggaaaccttactggttttgatccttactatcaaatctctttgacgcccagggatagttatcaaaaagagcttcgcacaatccccgtaactgattcttcaattatggtagacaaaagcaaaactatcaacagtcctggagtaacaaatgggttaaaaaacagaaaatccattgattcccaaacctgggaagagattctgggaaattgtggttctggagttgaagccttacctttgcagcctaacagtgagcatgaagtgctggaccaaatactcgaaagctcttttacaatgcaagattttgctagtctacaagagtccatggtcaaaagccagaatcaggagttaaattcaggacttacatctgatcgtaccgtgtggttccaaggacaagatatggagctaaatgctataagcaatctagcttcgaatgaaaaagctccatatctatctacgatgaaacaacatctgttacacggtgcattgggcgaagaaggtctgaaaaagatggacagtttcaatcgctggatgagcaaagaacttggagatgttggtgttatagctgatgcaaacgagtcctttactcaatcaagttcaagaacctactgggaagaagttgagagtgaggatgggtccaatggtcacaactctaggagggacatggatggatatgttatgagtccttccctctcaaaggaacagctctttagcatcaatgacttctctccaagctgggcttatgtgggttgtgaagtggtggtttttgtcactggaaaattcttaaagactcgggaggagactgaaattggcgagtggtcttgcatgtttgggcaaacagaagttccagcagatgttatatctaatggtattctccaatgtgttgctcctatgcatggggctggaagagttcccttttatgtaacatgttccaacagattggcatgcagtgaagtgcgtgaattcgagtataaggttgccgagtctcaagtttttgatagagaagcagatgatgagtctactattgacattcttgaggcaagatttgttaaactgttgtgctcgaaatctgaaaatacaagccctgtttctgggaatgacagtgatttgtcacaattgagcgagaagattagtttactacttttcgagaacgatgaccagttggatcagatgctcatgaatgaaatctcccaagaaaatatgaaaaacaaccttttgcaggaatttctgaaagaaagcttacactcatggcttttacaaaagatagcagaaggtggaaaaggtccaagtgttttggatgaaggtggccaaggtgtattacattttgcagcttctcttggttacaactgggccttagaaccaacaataatcgctggtgtaagcgttgattttcgcgatgtaaatggttggaccgcacttcattgggcagctttctttggcagggagaggataattggttcactcatagctcttggtgctgctcctggaactttaactgacccaaatccagatttcccatcaggaagcacaccttctgatctagcctatgctaatggtcacaaaggaattgctggttatctctcagaatatgccttaagagctcatgtttctttgctcagtctaaatgataaaaatgccgaaactgttgagatggctcctagcccatccagctcatcattgacagactcgttgacagctgtacgtaacgctactcaggcagcagctcggattcatcaggttttcagggctcagtctttccagaagaagcaactaaaagaatttggagataaaaagcttggaatgtcggaggagcgtgctctttcgatgcttgctcctaaaacacacaaatcaggaagggcacatagtgatgattccgtgcaagccgctgctattcggattcagaacaagttccgaggttacaagggaagaaaagactatttgattaccagacaaagaatcatcaaaatacaggctcatgtgagaggttatcagtttaggaaaaactacagaaagataatttggtcagtgggggtattagagaaggtgatattacgttggagacggaaaggagctggtttgcgcgggtttaagtcagaagcacttgttgagaagatgcaagacggaacagagaaagaagaagatgatgattttttcaaacaaggaagaaagcaaacagaggacaggctacaaaaagctcttgcaagagtgaaatccatggttcaatatcctgaagctagagatcaataccgtagattgctaaatgttgtcaacgacatccaagaaagcaaggttgaaaaagctcttgaaaattcagaagcaacttgttttgatgatgatgatgatctgatagatattgaagcattgttggaagatgatgacacattgatgttgcctatgtcctcatctttgtggaccagttaaatcac

SEQ ID NO: 2123 - DNA, 753 bp, Arabidopsis thaliana
ttacgtatctgcatgattattagttataaaagttattgcaaacattaaattactttcatagagagcaatcattatattaaggtaatttaattttattatatatagtcaagatttaaaggaataaagaaaagattctcaaaacatttcatctctctccaacaactattcaccacattcaatggagtcaccaccactatacgagatatcctcaagctcttcttctgaaaaacctagacaccatttccaatcccttgatctcttccctaacctcaaccaaaactcttgtatcaacaataccctaattgagcctttaccgcttattgatcgcataaacttgaactcaaacctagacctaaaccctaatcccttgtatgcggaagaaggagagcaagaggaggaagaagaagaagaccgtgaagtggacgtggacttacacatcggccttcctggttttggtaaaccaagcaatgatgctaaacagctgaagaagagaaatgggaaggagatcgccacatatgacgccggaaaaggcatcgagaatgaactttccggaaaggcatactggatcccggcgccggagcaaattctcatagggttcactcatttttcttgccatgtatgcttcaagacattcaatcgctacaacaatcttcaggtacgagtcaatatatctcatgcgcattgcttttccatgcacaaacatatataataaattcatcttatagagttatatctccggatctaatgttatga

SEQ ID NO: 2124 - DNA, 579 bp, Oryza sativa
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagcaagaggaataactactagctatatatgctgctaacctacttacaatcgcgatacatatcgaggtttggggattttcttctcacctgtgtgcagaggctgc

SEQ ID NO: 2125 - protein, 136 aa, Oryza sativa; identical to SEQ ID NO: 690

SEQ ID NO: 2126 - DNA, 514 bp, Oryza sativa
atcgatcatctgctacgaactcaccctatatatatatactccatcttaggagctgcttgatcgatcgacatatatataactaatggatcatcatcatcagcagcagcagcaggagggtgagctggtggccaagtacaggggcgtgcggcggcggccgtggggcaaattcgcggcagagatccgcgactcgagccggcacggcgtccgcgtgtggctgggcaccttcgacacagccgaggaggccgctcgcgcctacgaccgctccgcctactccatgcgcggcgccaacgccgtcctcaacttccccgccgacgcccacatctacgcccgtcaactacacaataataacgccgctgctggctcttcatcttcctcttccgccgccgccgcagcagccaggccgccgccgatcgagttcgagtacctcgatgaccacgtcctgcaggagatgctccgagaccacaccaccaacaagtagcttactactccactatatatgctgcctgctgcttgt

SEQ ID NO: 2127 - protein, 131 aa, Oryza sativa
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 2128 - DNA, 375 bp, Oryza sativa
atggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatga

SEQ ID NO: 2129 - protein, 124 aa, Oryza sativa
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 2130 - DNA, 321 bp, Oryza sativa
gctctaaactaccataaaatcttaactcggcattttttttttcacgctaatggaaagtagcggtggaagccagctgggaaagaattccaaaacaagtgatggtcgtgaaacaaaagaagttaatagcactgcgcaaaattttgttcatttcacagaagaagaggaagatattgttttcagaatgcacaggcttgtcgggaacaggtgggaacttatagctggaagaataccgggaaggacagcagaagaagtagagaagttctgggcaattaaacatcaagccacatgatagcagaaagaggatgtttgccccaaaagtag

SEQ ID NO: 2131 - protein, 79 aa, Oryza sativa
MESSGGSQLGKNSKTSDGRETKEVNSTAQNFVHFTEEEEDIVFRMHRLVGNRWELIAGRIPGRTAEEVEKFWAIKHQAT

SEQ ID NO: 2132 - DNA, 356 bp, Oryza sativa
cataaggtcataacaagggtctgaggatcttagctagcacaagatctcaactcggcatttcattggagtttttcacgcctaatggatagcagcagtggtagccagggaaagaattccaaaaccagtgatggttgtgaaacaaaagaagttaataacactgcacagaattttgttcatttcacggaagaagaggaagatctcgttttcagaatgcacaggcttgttgggaacaggtgggaacttatagctggaagaatccctggaagaacagcaaaagaggtagaaatgttctgggcagtaaagcaccagaatacataaggggggaaaaagggtgtatgccctaaaagtagcgtaca

SEQ ID NO: 2133 - protein, 78 aa, Oryza sativa; identical to SEQ ID NO: 1065

SEQ ID NO: 2134 - DNA, 1231 bp, Oryza sativa
ggccgcttctcttctccagcgtccgatctccccctctcgcctctccgcctcacctccgctccgcttcccacccccgcttcctctctctctcctctccccccccctctctctctctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggaggaggggggagccacgagagcgggagcccgagggggggagggggaggagggggaggtgggggtggggggggcccactcgtccggcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattcccaaaaaaaaaaaaaaaaaaaaaaaaaaaa

SEQ ID NO: 2135 - protein, 185 aa, Oryza sativa
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 2136 - DNA, 610 bp, Oryza sativa
tggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggatagtgaaaattttcagtaactggtgtcctctgtgagttattatccatctgttaaggaagaacccacattagggc

SEQ ID NO: 2137 - protein, 164 aa, Oryza sativa
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 2138 - DNA, 837 bp, Oryza sativa
gtcgagatccggcggccggtggcgtcctcctccctctccctcctccccaaccaacggcgctgatcccctccgccatctccgtccatctccgcctaaaaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtaggacgaggagtgtgatagcatctaggaaggagaaccatcgtttttagggaaagaacgctccagcatcctgttatgttgtaagcaggatgcttctaaagttccaataccttgttaccacgaatgttagtcgtcgttctttttgaaatgttcttgtgttagccaggatgtccaaatttgttgtaggttctagttcagtcgtgtgttgtgtggttgtgtctaaccatatttggccgtttccggctgtcctgcatatgctaaattcagaggggtaaagagatctaagaaaaaaaaaaaaaaa

SEQ ID NO: 2139 - protein, 143 aa, Oryza sativa
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKGSRASELPVKKDVVLNGDPGSSFEGM

SEQ ID NO: 2140 - DNA, 720 bp, Oryza sativa
gcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttgacatcgctccgagacgagtagcatgcaccat

SEQ ID NO: 2141 - protein, 219 aa, Oryza sativa
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 2142 - DNA, 761 bp, Oryza sativa
cctctcctcttcgtcttcctcctcgccttcgcttcgactgcttcgatcgagggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggt

SEQ ID NO: 2143 - protein, 224 aa, Oryza sativa
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 2144 - DNA, 920 bp, Oryza sativa
ccaggtcattgagacttgagagacatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaaaacgtcatgtatcgttgtgtgtcctcatccggtaatcctttacgtgggtgggttatggc

SEQ ID NO: 2145 - protein, 193 aa, Oryza sativa
MIILIVPLHLFWMSGGRNMDQVKKAAVRSDGVGGSATNAELPMANLVRLIKKVLPGKAKIGGAAKGLTHDCAVEFVGFVGDEASEKAKAEHRRTVAPEDYLGSFGDLGFDRYVDPMDAYIHGYREFERAGGNRRVAPPPPAAATPLTPGGPTFTDAELQFLRSVIPSRSDDEYSGSSPAIGGYGYGYGYGKNM

SEQ ID NO: 2146 - DNA, 257 bp, Zea mays
ctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatt

SEQ ID NO: 2147 - protein, 78 aa, Zea mays
MDSSSGSQDKKFRDNDRPEAKEANSTAQHLVDFTEAEEDLVSRMHRLVGNRWEIIAGRIPGRTAEEVEMFWSKKYQER

SEQ ID NO: 2148 - DNA, 534 bp, Zea mays
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctagc

SEQ ID NO: 2149 - protein, 164 aa, Zea mays
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 2150 - DNA, 735 bp, Zea mays
cggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgccgcctcagccgccacagcagcagcagcaacatcaacagcatcacatggcaataggaggcagaggaggattcggccaacaaggcggcggcggcggctcctcgtcgtcgtcagggcttggccggcaagacagggcgtgagttgcgacgatacgtcagaatcagaatcgctgat

SEQ ID NO: 2151 - protein, 222 aa, Zea mays
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 2152 - DNA, 803 bp, Zea mays
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttcaccat

SEQ ID NO: 2153 - protein, 212 aa, Zea mays
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYGGSPPAASSGSYPHHQMAMGGKGGAYGYGGGSSSSPSGLGR

SEQ ID NO: 2154 - DNA, 1322 bp, Zea mays
tattgtctatgagggaagcagatcctctacgctgcaattgggccactgacatgtgggaccaggtctagattggacccacacatcaatgaccgaaatgcagaagagggtctcgttgccactgtaagctatctcctagagttcagagcagggcaagaatcttgcaatgctcacatgaacataatataatcgttgtgttagctatgcgtcggcatcactaccgtcctcccactggcatctcccgtctactattttgggacgaacagaacagagacactagctaactagcttattagcttgctcccctccttcctttcaagctttaaaaggagaccatctcttgcaccacctcttcatccatccggccaagcaaggggcatgaagaacaggaagggctacgggcaccagggccacctgctgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccgctcaagtcctacctcaaccgctaccgcgaggccgagggcgagaaggccgccgtgctcggcggcggcgcgcgccacggcgacggcgcggcgcggcggacgacgccggcccactcgccgcgcaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggccaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaa

SEQ ID NO: 2155 - protein, 246 aa, Zea mays
MKNRKGYGHQGHLLSPVGSPLSDNESGAAAAAGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVAPLKSYLNRYREAEGEKAAVLGGGARHGDGAARRTTPAHSPRNGAGGPVGGYGMYGGAGGGSGMIMMMGQPMYGGSPPAASSGSYPHHQMAMGGKGGAYGYGGGSSSSPSGLGR

SEQ ID NO: 2156 - DNA, 268 bp, Zea mays
cctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagattt

SEQ ID NO: 2157 - protein, 78 aa, Zea mays; identical to SEQ ID NO: 2147

SEQ ID NO: 2158 - DNA, 302 bp, Glycine max
agaacttgttattgcaatgactgacatagatcgctcctctgataatgtttcttctgattctattgagaaatcaagccaagtttctgatgttgaattttctgaagctgaggaaatccttattgccatggtgtataatctggttggagaaaggtggtctttgattgctggaagaattcctggaagaactgcagaagaaatagagaaatattggacttcaagattttcgactagccaatgaagtggcagaaattaaacgaagcaagacaattttgggtgcctgcaactcattatacagtgactta

SEQ ID NO: 2159 - protein, 73 aa, Glycine max
MTDIDRSSDNVSSDSIEKSSQVSDVEFSEAEEILIAMVYNLVGERWSLIAGRIPGRTAEEIEKYWTSRFSTSQ

SEQ ID NO: 2160 - DNA, 258 bp, Glycine max
gagaacttgttattgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 2161 - protein, 74 aa, Glycine max
MADIDRSFDNNVSAVSTEKSSQVSDVEFSEAEEILIAMVYNLVGERWSLIAGRIPGRTAEEIEKYWTSRFSTSQ

SEQ ID NO: 2162 - DNA, 250 bp, Glycine max
gttattgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 2163 - protein, 74 aa, Glycine max; identical to SEQ ID NO: 2161

SEQ ID NO: 2164 - DNA, 264 bp, Glycine max
attctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactac

SEQ ID NO: 2165 - protein, 75 aa, Glycine max
MADSDLSSSQISTHSTDSGNRGSSKVEFSEDEETLIIRMYKLVGERWSIIAGRIPGRTAEEIEKYWTSRFSGSSE

SEQ ID NO: 2166 - DNA, 268 bp, Glycine max
actcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactacc

SEQ ID NO: 2167 - protein, 75 aa, Glycine max
MADSDRSSSEVSTHSTDSGKRGSSKVEFSEDEETLIIRMYKLVGERWSLIAGRIPGRTAEEIEKYWTSRFSGSSE

SEQ ID NO: 2168 - DNA, 285 bp, Glycine max
cagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgta

SEQ ID NO: 2169 - protein, 80 aa, Glycine max
MSTTATTTSEEVSSNEWKVIHMSEQEEDLIRRMYKLVGDKWNLIAGRIPGRKAEEIERFWIMRHGDAFSVKRNGSKTQDS

SEQ ID NO: 2170 - DNA, 555 bp, Glycine max
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttcta

SEQ ID NO: 2171 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 2172 - DNA, 556 bp, Glycine max
gtagggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatc

SEQ ID NO: 2173 - protein, 173 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 2174 - DNA, 547 bp, Glycine max
taaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcaacagcagcagcatcagggacacgtgtatggatctggaactactactggatcagcatcttctgcaagaactagataacaggtttatgca

SEQ ID NO: 2175 - protein, 171 aa, Glycine max
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 2176 - DNA, 1818 bp, Glycine max; identical to SEQ ID NO: 802

SEQ ID NO: 2177 - protein, 170 aa, Glycine max
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 2178 - DNA, 553 bp, Glycine max
gatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatagcatgtgtcatct

SEQ ID NO: 2179 - protein, 177 aa, Glycine max
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQGHVYGSGSASSARTR

SEQ ID NO: 2180 - DNA, 600 bp, Glycine max
tcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttat

SEQ ID NO: 2181 - protein, 188 aa, Glycine max
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 2182 - DNA, 528 bp, Glycine max
ggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattc

SEQ ID NO: 2183 - protein, 165 aa, Glycine max
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 2184 - DNA, 568 bp, Glycine max
tcgacttgtagggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttctacgcatcgc

SEQ ID NO: 2185 - protein, 174 aa, Glycine max; identical to SEQ ID NO: 2171

SEQ ID NO: 2186 - DNA, 602 bp, Glycine max
ttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcagagttcatcagcttcatcaccggcgaggcctccgacaagtgccagcgcgagaagcgcaagacgatcaacggcgacgacctgctctgggcgatgaccactctgggcttcgaggactacgtggagcctctcaaaggctacctccagcgcttccgagaaatggaaggagagaagaccgtggcggcgcgtgacaaggacgcgcctcctcttacgaatgctaccaacagtgcctacgagagtgctaattatgctgctgctgctgctgttcctggtggaatcatgatgcatcagggacacgtgtacggttctgccggcttccatcaagtggctggcggggctataaagggtgggcctgcttatcctgggcctggatccaatgccggtaggcccagataaagagcctattatta

SEQ ID NO: 2187 - protein, 191 aa, Glycine max
MADSDNDSGGAHNGGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPLTNATNSAYESANYAAAAAVPGGIMMHQGHVYGSAGFHQVAGGAIKGGPAYPGPGSNAGRPR

SEQ ID NO: 2188 - DNA, 579 bp, Oryza sativa
atggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccaggtcaatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggtcaacctactaaccataggaagtctcatccaccaagaaaacatggaactgtacagaaaggtcaacctgattcgccaagaaaatgctgagctgtacaagaaggtaagccaacaaaatgatgctgagcaaaccacacctcctaaactagggtaa

SEQ ID NO: 2189 - protein, 192 aa, Oryza sativa
MGRGKIVIRRIDNSTSRQVTFSKRRNGIFKKAKELAILCDAEVGLVIFSSTGRLYEYASTRSMKSVIDRYGRAKEEQQHVANPNSELKFWQREAASLRQQLHSLQENHRQLMGQDLSGLGVKELQTLENQLEMSIRCIRTKKVNLLTIGSLIHQENMELYRKVNLIRQENAELYKKVSQQNDAEQTTPPKLG

SEQ ID NO: 2190 - DNA, 1105 bp, Glycine max
gtcttgtcctccctccttcttcttctctcccctgcttctctttctccttccaaatcactcctataattttcaagtccaaggtggtatttgtgaaggaaccctaaaatataattttttgaccaaagatggggagaggtaagattgcgattcgaaggatcgacaactccactagccggcaagtgactttctcaaagagaagaaatggattgctgaagaaagctagagaattatcaattctttgtgatgctgaagttggattgatggtgttctccagcactgggaagctttatgactatgcaagcacaagcatgaaagcggttattgaacgctacaacaagctaaaagaggaaccccatcacctcatgaatccggcttcagaagcgaagttttggcagacagaagcagcaagcttgaggcagcagcttcagtacttgcaggaatgccacaggcaattaatgggggaagaacttatgggtttgggtattaaagaactacaaagtctggaaaaccaactggagatgagtttaaagggtgtccgcatgataaatgaccagattgtaactaatgagatcgaagaactacgcctaaatggaaatctcattcatcaagaaaatgttgaactctatcaaaagatggagcagatccaaaaagaaaatgcagagctacagaagaaggtttatgaagcaaggagtacaaatgaagaaaatgtggcatccaatccttcttataaggtcagaaatggatatgatttacatgcacctattagtctccaactaagtcagccacagcctcaatacagtgaaccatcagccaaagcaataaaactcggattgcagctgcattagcaaaaactgttcagtaatcggggaggttgtcattttgtaccaagcagccaacaaagcaacaacttctccctagaatgatcagacttctttgagttggatcttgtagttcatcaaccacatttgttccattcaacagtacaacatatgtatggtacgagattatctaccaagaagcatacaattgctgttaaggatcagacataatgtttacctttgtaaattttgtgcaataaaaacataacacaattgagtctggtgtt

SEQ ID NO: 2191 - protein, 239 aa, Glycine max
MGRGKIAIRRIDNSTSRQVTFSKRRNGLLKKARELSILCDAEVGLMVFSSTGKLYDYASTSMKAVIERYNKLKEEPHHLMNPASEAKFWQTEAASLRQQLQYLQECHRQLMGEELMGLGIKELQSLENQLEMSLKGVRMINDQIVTNEIEELRLNGNLIHQENVELYQKMEQIQKENAELQKKVYEARSTNEENVASNPSYKVRNGYDLHAPISLQLSQPQPQYSEPSAKAIKLGLQLH

SEQ ID NO: 2192 - DNA, 1019 bp, Glycine max
attcggctcgaagggcgctttgtctgttataatcaacgcgctcctcacgagtgaatttctggttcggaaggatctgattgttagggtttggtatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaaattttggcaaagggaggcagcaatgttaaggcaacaattacacaatttgcaagaaagtcaccgcaggaaaatgatgggggaagaactgtcaggcttgacagtcaaagaattaccaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctcacaaatggtctaggcataggagaggatttgcaagtgcctgtgaatctccagctaagccagccaagcaccagcaacaacactacaaggcaccttcaggaactacaaaaatgggcagattgcaattgcattgatccatatacaggatgcgtgtgtttcacaattgctatcaagaaaaatggactcagatttaaacctcgatgtcttcgtataaatgttgtggcatatagaccacagacaaattggcttaaagattttaatttgaaattatcagaaaaagaaaaggcaaccctagcatgtatgtaagaaacaatgaaagcatcttatgagaaaccaagactcaaatcaaggaagaaattcttccacccgccc

SEQ ID NO: 2193 - protein, 286 aa, Glycine max
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELPNLENQLEISLHGVRMKKDQLLMGEIQELNRKGNLIHQENVELYKKVYGTQDDNETNRDSVLTNGLGIGEDLQVPVNLQLSQPSTSNNTTRHLQELQKWADCNCIDPYTGCVCFTIAIKKNGLRFKPRCLRINVVAYRPQTNWLKDFNLKLSEKEKATLACM

SEQ ID NO: 2194 - DNA, 1074 bp, Zea mays
gcgcgagagagaaagagagcagcttctccatctagctagtagttagagagatgtagtactagctagctagctagtaccaccggcgacaaggtagttaggtttctcctctttctctctctagatctgtgctgctaggaaggatcggagatggggagagggaagatagagatcaagaggatcgacagcgcgacgagccggcaggtgaccttctccaagcgccgcagcgggctgttcaagaaggccaaggagctcgccatcctttgcgatgccgaggtcggcctcgccgtcttctccagcaccggccgcctgtatgacttcgctagcaccagcatgaaatgtgtgattgaaagatacagcgaggcaagagaggaacaccgtcagactatgagcgcaagtgctgaggccaagttctggcaaagcgaggcagaaagcttgaggcagcaactgcataacttaaaagagcaccatcggcagttgttgggtcagcagctttctggcctgaacgtgggagatttgcagaatttagagaataagctggagacgagcctaagaaatattcgtctgaaaaaggaccaacttattttttatcagattcaagaattaaacaggaagggaagcctcatgcaccaggaaagcatggaactatacaacaaagttaaccttcttcatcaacataacactgaattacggagaaaggtgtatggacaaggagtaaataatgagcaaacaagtactactgttagacacagtactcggaatacagagaatcttccgatcaatcttgagctaagtgtgcaaagggacaaatcagaaacaccaagtgtagggtgagatttttgtccaaacttcaggataactcagagtcagtaaaccagatgatttaataaagaacactgaaagtgccataagactttaaatacagtgaggataactaaaccgagtgataagaaatggatatcgttggttgaattgcaagacctaacagctaaactttaagctgctagatgcgattgtttatgtatgaagaagaatgttgattttaatttagcttttcatataaaaaaaaaaaaaaaa

SEQ ID NO: 2195 - protein, 227 aa, Zea mays
MGRGKIEIKRIDSATSRQVTFSKRRSGLFKKAKELAILCDAEVGLAVFSSTGRLYDFASTSMKCVIERYSEAREEHRQTMSASAEAKFWQSEAESLRQQLHNLKEHHRQLLGQQLSGLNVGDLQNLENKLETSLRNIRLKKDQLIFYQIQELNRKGSLMHQESMELYNKVNLLHQHNTELRRKVYGQGVNNEQTSTTVRHSTRNTENLPINLELSVQRDKSETPSVG

SEQ ID NO: 2196 - DNA, 1209 bp, Zea mays
gaattcccgggtcgacccacgcgtccgcccacgcgtccggtcgtcctcttctctcgcctccaataattcgtaaccattctccttccaggccgggctcctgctggccggagttcccatctccctctttccttctcggttactatccgtgagtgtgcctgcccccgtgtgtgcgcgtgcaagatcgaccgggcgcagcttcacgatggggcgcggcaagatagtgatccgccggatcgacaactccacgagccggcaggtgacgttctccaagcggcggaacgggatcttcaagaaggcaagggagctcgccatactctgcgacgcagaggtcgggttggtcatcttctccagcaccggtcgtctctatgaatacgccagcacaagcataaagtcagtgattgatcgatatggtcgagcaaaggaggaggagcatgtagcagaccccaacacagagcttaagttctggcaaagggaggcagcaagcttgagacaacaactgcacaacttgcaagaaaatcatcggaggcagttgatgggacaaaatctttctggactaggtgtcaagggacttcaaaatctagaaaatcagctagagatgagcatttgttgcatccggacaaaaaaggaccaactcttggttgacgaaattcacgaactgaatcgaaagggaagtctcatccaacaagacaacatgggattacacagaaaggtcaacctaattcgtcaagaaaatgccgaattatataagaagctctatgagaaagaagcagaaggtgaagtcaaccgagattcaacaactccgtacaactttgtagttgcagagggtgccaacgttcctatccatcttgagcttaatattccactgcaagaaaatggtgttgagcaacctgtggctcctaaattagggttgcaattaaatcaatgaagacatgcaggacattgcctttgttctcattgtccttgaagtctgcaactcaaagcagcctaaaatgataggttgtaacaggcctaaaaacattgcaagacaaataaagtatgcatgccagagacagtggcaatggtagtgcaaatctatctcaaataacttgtgttatattgaataatccagcaaatggtttgttttttacacgttatgcaagtttgtttgaccaaaatggtatgtaacatgtacaaatttccaagtgaacttattgaaaaaattctataaaa

SEQ ID NO: 2197 - protein, 240 aa, Zea mays
MGRGKIVIRRIDNSTSRQVTFSKRRNGIFKKARELAILCDAEVGLVIFSSTGRLYEYASTSIKSVIDRYGRAKEEEHVADPNTELKFWQREAASLRQQLHNLQENHRRQLMGQNLSGLGVKGLQNLENQLEMSICCIRTKKDQLLVDEIHELNRKGSLIQQDNMGLHRKVNLIRQENAELYKKLYEKEAEGEVNRDSTTPYNFVVAEGANVPIHLELNIPLQENGVEQPVAPKLGLQLNQ

SEQ ID NO: 2198 - DNA, 1268 bp, Zea mays; identical to SEQ ID NO: 1757

SEQ ID NO: 2199 - protein, 256 aa, Zea mays
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIPRRVKLPSYDAEGNYLL

SEQ ID NO: 2200 - DNA, 1635 bp, Oryza sativa
gaccctcaccacgcctccccatacggatcgcctcatggaggccgccgttgctgctgcggctgcggccgccggggcggtgacgacggcggtcgcgcctccgcccggcgcggcggtcagcaacggggtggcgaccgcgccgccgccgttcctgatgaagacgtacgagatggtggacgacccggccaccgatgccgtcgtctcatggggccccgggaacaacagcttcgttgtgtggaacacccccgagttcgcgcgcgacctcctccccaagtacttcaagcacagcaacttctcctccttcgtcaggcagctcaacacctacggatttaggaaagttgatccagataggtgggagtttgcaaacgaaggttttcttagaggacaaaagcatctactgaagaccatcaacagaaggaaaccaactcatggaaacaaccaagttcagcagcctcagttgccagctgctcctgtacctgcttgcgtagaagtggggaagtttgggatggaagaagagattgagatgctcaaaagggataaaaatgttttaatgcaggaacttgtcaggctgagacaacaacagcagacaacagatcatcagctgcagactttgggcaagcgtcttcaaggaatggagcaacggcaacaacaaatgatgtctttcctggctaaggcaatgcatagtcctggcttcctagcacaatttgtacagcaaaacgaaaacagcagaagaagaatagttgctagtaacaaaaagaggaggctaccaaagcaggatggttcgttggactctgaaagtgcttcattggatggacaaatagtaaaatatcaacctatgatcaatgaagcagccaaagcgatgctaaggaagatcctaaagctagattcttcacatagatttgaatccatgggcaattcagataatttccttcttgagaattatatgccaaatggtcaaggtcttgacagctcttcatcaactcggaattctggtgttacccttgcagaggtcccagctaactcaggtttgccatatgtagctacaagctctggactttcagctatttgttcaacttcgactcctcagattcagtgcccagttgttttggacaacggcatacccaaagaagttccaaacatgagtgcggtgccttctgttccgaaggctgtggctccaggcccaactgatatcaatattctggaattcccagatttgcaagatatagtagctgaagaaaatgttgatattcctggagggggctttgaaatgcctggtcctgagggtgtattctctttgcctgaagaaggtgatgatagtgttcccattgagactgatgagattttgtacaacgatgacacccagaaacttcctgctatcattgattctttctgggaacagttcctggtggctagccctctatctgttgataatgatgaagtcgattcaggtgtactagaccaaaaggaaacacaacaggggaatggatggaccaaagctgaaaacatggctaaccttacagaacagatgggcctcctgtcatcacaccatacaggatgatgaggtacaataggacatacttagccaccatttgtcaaggtaccctgggatctcggtaataaactcccacatcatcacct

SEQ ID NO: 2201 - protein, 506 aa, Oryza sativa
MEAAVAAAAAAAGAVTTAVAPPPGAAVSNGVATAPPPFLMKTYEMVDDPATDAVVSWGPGNNSFVVWNTPEFARDLLPKYFKHSNFSSFVRQLNTYGFRKVDPDRWEFANEGFLRGQKHLLKTINRRKPTHGNNQVQQPQLPAAPVPACVEVGKFGMEEEIEMLKRDKNVLMQELVRLRQQQQTTDHQLQTLGKRLQGMEQRQQQMMSFLAKAMHSPGFLAQFVQQNENSRRRIVASNKKRRLPKQDGSLDSESASLDGQIVKYQPMINEAAKAMLRKILKLDSSHRFESMGNSDNFLLENYMPNGQGLDSSSSTRNSGVTLAEVPANSGLPYVATSSGLSAICSTSTPQIQCPVVLDNGIPKEVPNMSAVPSVPKAVAPGPTDINILEFPDLQDIVAEENVDIPGGGFEMPGPEGVFSLPEEGDDSVPIETDEILYNDDTQKLPAIIDSFWEQFLVASPLSVDNDEVDSGVLDQKETQQGNGWTKAENMANLTEQMGLLSSHHTG

SEQ ID NO: 2202 - DNA, 1799 bp, Glycine max
attcggctcgaggtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattcgccacagacatcttgcccaatcattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcgcctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgcttttaaggccaagcccacttacagaaggcacagaggaaactaaatgtagctctctaggatgtggtttgactgatgatcagggtttgccttcagaaatgggaaataagcaggaaaattttgatacgatactacatgttgaccgtcttactcaacagatgggacttcatgcattggagtactgattgtgtgtatatatgttactcgcaactgaaggtaaactttttagcttgcagcctctcacttatgcataactttataagcatactggctctcttagttccctgaactgaaaccagtgtaaaatctcctgtcattgtcatcatacccaattgctgccattaaagagtgagaacagtgaggcagtaaatcaggagtgtttaaaacaattacagtgaatgtctacgaaaatgtctgatgtattatgatcttacatacacattattaggatagaaatttactacgtaacaaaaaa

SEQ ID NO: 2203 - protein, 464 aa, Glycine max
MEGASWNSSVCVAPFLSKTYDMVDDPSTDLVVSWGENNNSFVVWNVPQFATDILPNHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQSPGFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGMETESSLLNHELNVMGADTRNMGEIDMMSTVLDEADEADHFSPDTDGISKLPEISDEFWELLLRPSPLTEGTEETKCSSLGCGLTDDQGLPSEMGNKQENFDTILHVDRLTQQMGLHALEY

SEQ ID NO: 2204 - DNA, 1819 bp, Glycine max
ggagggaagtggaagctagtagtccgtttcagcgtgtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattcgccacagacatcttgcccaatcattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccatgcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactgattgtgtgtatatatgttactcacaactgaaggttgaggtcccctttgctactgagcagacaaagccatcttacttatacaacaaagaaacctgacagatccaacaacttgatcggtgcttttatccgcttgtaatgtcgtcgtgtgttctgtttgtcattgggggcttaaaaacatacaagttcacgaaacttcatatatctccatgtattttgaattttaataactatgcccccgtttccaatgcgatgatatttttgtggggatgttccgtatacaaaaaaaaaa

SEQ ID NO: 2205 - protein, 464 aa, Glycine max
MEGASWNSSVCVAPFLSKTYDMVDDPSTDLVVSWGENNNSFVVWNVPQFATDILPNHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQSPCFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGMETESSLLNHELNVMGADTRNMGEIDMMSTVLDEADEADHFSPDTDGISKLPEISDEFWELFLRPSPLTEDTEETKCSSLGCGLTEDQGLPSEMGNKQENFDTIQHVDCLTQQMGLHALEY

SEQ ID NO: 2206 - DNA, 1803 bp, Glycine max
gatactctcctcttatcttctgcttcttcttccttcttctctgagcgataaagcagcaaaaacctaaaattaggggtttatggagggagcatcgaggaatggtagtgtttgtgtggcaccgtttctgagcaagacatacgacatggtcgatgatccttccaccgactcggtggtgtcgtggggcaaaaacaacaacaccttcgttgtttggaacgttccccaattcaccacagacatcttgcccaaacattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagaagccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggttggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactgattgtgtgtatatatgttactcacaactgaaggttgaggtcccctttgctactgagcagacaaagccatcttacttatacaacaaagaaacctgacagatccaacaacttgatcggtgcttttatccgcttgtaatgtcgtcgtgtgttctgtttgtcattgggggcttaaaaacatacaagttcacgaaacttcatatatctccatgtattttgaattttaataactatgcccccgtttccaatgcgatgatatttttgtggggatgttccgtataattggatcataactcttgaattgctgttgaataactactgtttactgaagcta

SEQ ID NO: 2207 - protein, 464 aa, Glycine max
MEGASRNGSVCVAPFLSKTYDMVDDPSTDSVVSWGKNNNTFVVWNVPQFTTDILPKHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQKPGFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGLETESSLLNHELNVMGADTRNMGEIDMMSTVLDEADEADHFSPDTDGISKLPEISDEFWELFLRPSPLTEDTEETKCSSLGCGLTEDQGLPSEMGNKQENFDTIQHVDCLTQQMGLHALEY

SEQ ID NO: 2208 - DNA, 466 bp, Oryza sativa
gtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagctagctagctactatggc

SEQ ID NO: 2209 - protein, 141 aa, Oryza sativa
MEDDKSKEGKSSSSYRGVRKRPWGKFAAEIRDPERGGARVWLGTFDTAEEAARAYDRAAFAMKGATAMLNFPGDHHHGAASRMTSTGSSSSSFTTPPPANSSAAAGRGGSDRTTDKVELECLDDKVLEDLLAETNYRDKNY

SEQ ID NO: 2210 - DNA, 393 bp, Zea mays
atggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcgccatgaagggcgccacggccgtgctcaacttccccgccagcggaggatcgtcagctggcgcggctcccggcggccggaccagcggcggctcctcctcgtccaccacgtcggctccggccagcagggggagggcccgtgttcccgactcggagaaggtggagctggagtgcctcgacgacagggtcttggaagagctgctcgcggaagacaagtacaacaagaactaa

SEQ ID NO: 2211 - protein, 130 aa, Zea mays
MEDDKKEGKYRGVRKRPWGKFAAEIRDPERGGSRVWLGTFDTAEEAARAYDRAAFAMKGATAVLNFPASGGSSAGAAPGGRTSGGSSSSTTSAPASRGRARVPDSEKVELECLDDRVLEELLAEDKYNKN

SEQ ID NO: 2212 - DNA, 477 bp, Zea mays
tacgtccgatccacagccatcatcgccacccgcgcgcttatggatggcgagtggtccaaggacggcggaggcggcgagccgaccaagtaccgcggcgtgcggcgtcggccctggggcaagtacgcggcggagatccgcgactcgagccggcacggcgtccgcatctggctcggcacgttcgacaccgccgaggaggccgccagggcgtacgaccgctccgccaactccatgcgcggcgccaacgccgtgctcaacttcccggaggacgcgcccgcctacgccgccgccgcctcccgtggctccgccggcggatcctcgtccagaccggcgggctccggccgggacgtgatcgagtttgagtacctcgacgacgaggtgctgcaggagatgctcaggagccaggagccgtcggcggcggcggcgcagaagaagaagtagcgcgagcgccacaggtggcgaaacggccgcttttccaaa

SEQ ID NO: 2213 - protein, 132 aa, Zea mays
MDGEWSKDGGGGEPTKYRGVRRRPWGKYAAEIRDSSRHGVRIWLGTFDTAEEAARAYDRSANSMRGANAVLNFPEDAPAYAAAASRGSAGGSSSRPAGSGRDVIEFEYLDDEVLQEMLRSQEPSAAAAQKKK

SEQ ID NO: 2214 - DNA, 717 bp, Glycine max
ctaacacacataacaataacttagcaacattttttccttccttctttctttctttctatactttttgttgttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttgatttttttttttttttttgtagctgatcaaagttcttcgaaatga

SEQ ID NO: 2215 - protein, 158 aa, Glycine max
MEGGRSSVSNGNVEVRYRGIRRRPWGKFAAEIRDPTRKGTRIWLGTFDTAEQAARAYDAAAFHFRGHRAILNFPNEYQSHNPNSSLPMPLAVSAPPSYSSSSSTSNYSGDDNNNHLVRPAFSGEIMQGGDHDDDTFELEYFDNKLLEELLQMQDNRHF

SEQ ID NO: 2216 - DNA, 609 bp, Glycine max
tttctttctttctatactttttgtggttctgattattaagttctaagagaataacaatggagggtggaagatcatctgtttcaaatgggaattgtgaggttcggtatagagggattagaagaaggccatggggcaagtttgcagcagagattcgtgaccctacgaggaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctgctgatgataataaccaccttgtgagacctggagaaataatgcaaggtggtgatcttgatgacacttttgagttggagtacttggataataagttgctcgaggaactccttcagatgcaagataacagacacttctaaaagtaaaatataacacaagccagctatgttgtgttagtcactggcatgaaataaaatgcaaagaaatattgttgattttatttaatatattttgttt

SEQ ID NO: 2217 - protein, 151 aa, Glycine max
MEGGRSSVSNGNCEVRYRGIRRRPWGKFAAEIRDPTRKGTRIWLGTFDTAEQAARAYDAAAFHFRGHRAILNFPNEYQSHNPNSSLPMPLIVPPPSYSSSFTSNYSADDNNHLVRPGEIMQGGDLDDTFELEYLDNKLLEELLQMQDNRHF

SEQ ID NO: 2218 - DNA, 440 bp, Glycine max
aaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaa

SEQ ID NO: 2219 - protein, 138 aa, Glycine max
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 2220 - DNA, 1096 bp, Glycine max
ggccactctctctctttaacctgcctcaccaactcgcatctagaagcaattatagggtctttctctcttctctctctatgttctgtcccctctactttggagtcaaaagcctataaaaccacacccaaacttcctcttgagccggcttcttaatttgttgctgcaagccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggccttctccggtgcggcaagagctgccgtctccggtggatcaactacctccgccccgacctcaaaagaggtaactttaccgaagaagaagatgaactcatcatcaaactccacagtctcctcggtaacaagtggtctttgatagctggaagattgccggggagaacagacaatgaaataaagaattattggaacacgcacataagaaggaagcttttgaacagaggaatcgaccctgctactcataggccactcaacgaagctgcttctgctgcaactgttacaactgccaccactaatatatcttttgggaaacaacaagaacaagagacaagttctagtaacggaagcgttgttaaaggttccatcttggaacgctgccctgacttgaaccttgagttaaccattagtcctcctcgccaacaacaacctcagaagaatctttgttttgtttgcagtttgggtttgaacaacagcaaggattgtagctgcaacgttgccaacactgttactgttactgtcagcaacactactccttcttctgctgctgctgctgctgctgctgcttatgatttcttgggcatgaaaaccaacggtgtttgggattgcacccgcttggaaatgaaatgaaaattcaacgaaattataccaattagttagtgtttttggagagaagtcgagagaatgaaattcattaat

SEQ ID NO: 2221 - protein, 253 aa, Glycine max
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAASAATVTTATTNISFGKQQEQETSSSNGSVVKGSILERCPDLNLELTISPPRQQQPQKNLCFVCSLGLNNSKDCSCNVANTVTVTVSNTTPSSAAAAAAAAYDFLGMKTNGVWDCTRLEMK

SEQ ID NO: 2222 - DNA, 1172 bp, Glycine max
ctttaacctgtctcaccaactcgcatctagaagcaattagggtctcccttttctctctatgtctcctttggagtcaaaagcctataaaaccacacccaaactccctcttgagccggcttcttaaatatttgttgctgcaagctagccaatcctaattcctattcctatccttattactacataactctaaagtaagtaagaaaaatagagcaatttcacaacacaacacaactcttataattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgttaatttttgaattttctctcctattttttcttttttttcttctcttatttgtataaataattagtcgctgatatgcataatatatagtaacggtacagttgaaca

SEQ ID NO: 2223 - protein, 246 aa, Glycine max
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQEQQETSSSNGSVVKGSILERCPDLNLELTISPPRQQQQTQKNLCFVCSLGLHNSKDCSCNVSNAVTVNNTTPSSAAAAAYDFLGMKTSGVWDCTRLEMK

SEQ ID NO: 2224 - DNA, 1082 bp, Glycine max; identical to SEQ ID NO: 702

SEQ ID NO: 2225 - protein, 179 aa, Glycine max
MSRSSAMHGITSTNNKLKGVRRRKWGKWVSEIRVPGTQERLWLGTYATPEAAAVAHDVAVYCLSRPSSLDKLNFPETLSSYSVQLRDMSPRSVQKVASDVGMDVDARNIVAGKTSTVGAETNCESDERTSTASVCNVVGEGGADHSDVFWWDDDGGSWHGSGGDSTERDALSISIEDYL

SEQ ID NO: 2226 - DNA, 687 bp, Oryza sativa
atgccttttgtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 2227 - protein, 228 aa, Oryza sativa
MPFVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLVAARDAAPAPAPATAYARPDHCAGATTARHDELARRGMYGAHAHAAGANARTSGERQLVCAEEISVDDMEILM

SEQ ID NO: 2228 - DNA, 656 bp, Brassica rapa
cccacgcgtccgatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccattgtttccaagacttcgccgaggtctatccagcaagctgcttctaatgccggaatggccgttgacgccggaatcgttaacagctgtgatcacgcgtcagggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaagcagtgatggagcctggtgtgtaagcaagcaaaacgttgtgaatatatataccggtatgtttcgctgttggcccaatgcaagaaacttttgtagtacgaatatatatattttattttgaatgccttcaagaggattataatgcgagtgaagctttgtttca

SEQ ID NO: 2229 - protein, 144 aa, Brassica rapa
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 2230 - DNA, 649 bp, Brassica oleracea
cagccgcataacatattactattccccctggtcatatctttgacttttatttttatttgctctaacctaaaagtattatataagtattgcacaattcatacaatcggaattgactttcttctcctccaatcgtatttttattcaacagttcctctcaagatcatcaactcaaaaaatggatcctagagacggcggagaaacccatcaggccaagtacaaaggcatccgtcgccggaaatggggaaaatgggtatcggagattagggttccagcaactcgtgaacgactctggttaggctctttctccaccgccgaaggagctgcggtagcccacgacgtcgctttttactgcttgcaccgaccatcttctctcgacaacgaagcttttaacttccctcacttgctgcaaccttcccttgcctccaacacatctcctaagtccatacaaaaagctgcttcggacgcaggcatgggcgtagacgcaggattcgccctaaacaacgacagcgcgagtggtggcgtggaggaaggcaccgaacgggaaacgttgaacatctccgtgtacgattatctagacgacggtcgcatttgatatattggtttatatctacgagcaccttatattagtaattaatataggatgtgaata

SEQ ID NO: 2231 - protein, 138 aa, Brassica oleracea
MDPRDGGETHQAKYKGIRRRKWGKWVSEIRVPATRERLWLGSFSTAEGAAVAHDVAFYCLHRPSSLDNEAFNFPHLLQPSLASNTSPKSIQKAASDAGMGVDAGFALNNDSASGGVEEGTERETLNISVYDYLDDGRI

SEQ ID NO: 2232 - DNA, 495 bp, Zinnia elegans
attcgcggccgcgaatatgagtaccagctcagatgaaggtaacaactgtttaagccaaaagacttacaaaggcgttaggtgccgacgatggggcaaatgggtgtcagagattcgagttccaggaagtcgagaacggctctggctaggcacgtactctacgcctgagggtgcagctgtggctcatgatgtagcctcgtactgtttaaaagggaatacgtcttttcataaacttaatattccgtctatgttacctccgacagcacggacagacctatctcctaggtccatccaaaaggctgcgtctgatgctggtatggccatagacgcacggtttatcgcgtctagagataccacaccgactaatgaggcgttgaacatttctgtagatgattatctttaaattttgagaactaatattgtgtcaccaatattgtaagtcgatctacattggcaaacacaatgtacgtgtttggtggcacttccagattattgttt

SEQ ID NO: 2233 - protein, 127 aa, Zinnia elegans
MSTSSDEGNNCLSQKTYKGVRCRRWGKWVSEIRVPGSRERLWLGTYSTPEGAAVAHDVASYCLKGNTSFHKLNIPSMLPPTARTDLSPRSIQKAASDAGMAIDARFIASRDTTPTNEALNISVDDYL

SEQ ID NO: 2234 - DNA, 594 bp, Oryza sativa
atgggccgggtggcggcgagcggcggcggcggcggcggaggggagatgatgaggtacaggggcgtgcggcggcggcggtgggggaagtgggtgtcggagatccgggtgcccgggacgcgggagcgcctgtggctcggctcctacgccaccgccgaggccgccgccgtcgcgcacgacgccgccgtctgcctcctccggctcggcggcggccgccgcgccgccgcaggcggaggcggcgggctcaacttccccgcccgcgcgctcgccgcggcggcggccgcctcctcctacggcggcgccggcggtctcctgtccccgcgctccgtgcagcgcgtggcgtccgacgccggcatggccgccgacgcgcagctcgtggacctgcgccgcgaccacccgcccgccgccgccgccgcctcatcctccggcagcggcgtggcgggagacggtgcaagaaagcaagggacacgtggcgaggttagcgacacgtattggtgtaggaatggagaggatgggagcagaagccggagctccgggagtgaggagctcattgtttacgagggcttaagtgtagatgacatggaaattttgatgtaa

SEQ ID NO: 2235 - protein, 197 aa, Oryza sativa
MGRVAASGGGGGGGEMMRYRGVRRRRWGKWVSEIRVPGTRERLWLGSYATAEAAAVAHDAAVCLLRLGGGRRAAAGGGGGLNFPARALAAAAAASSYGGAGGLLSPRSVQRVASDAGMAADAQLVDLRRDHPPAAAAASSSGSGVAGDGARKQGTRGEVSDTYWCRNGEDGSRSRSSGSEELIVYEGLSVDDMEILM

SEQ ID NO: 2236 - DNA, 702 bp, Oryza sativa
atggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgaccgctcaacttcccggagcgcgcggcggccaccgtacggcggccgccgtggcgcgcctgtcgccgcggtccgtgcagcgcgtggcgtccgacgcggcatggccgccgacgcgcagctcggcgtgccgggacccggcccggcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 2237 - protein, 233 aa, Oryza sativa
MADLPCIYIRVVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATAQLPGARGGHRTAAAVARLSPRSVQRVASDAAWPPTRSSACRDPARPAPATAYARPDHCAGATTARHDELARRGMYGAHAHAAGANARTSGERQLVCAEEISVDDMEILM

SEQ ID NO: 2238 - DNA, 929 bp, Arabidopsis thaliana
cttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatac

SEQ ID NO: 2239 - protein, 213 aa, Arabidopsis thaliana
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 2240 - DNA, 803 bp, Arabidopsis thaliana
ctgatcaatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaaaattcgatttttatttccatttttggtattatagctttttatacatttgatccttttttagaatggatcttcttctttttttggttgtgagaaacgaatgtaaatggtaaaagttgttgtcaaatgcaaatgtttttgagtgcag

SEQ ID NO: 2241 - protein, 207 aa, Arabidopsis thaliana
MFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 2242 - DNA, 908 bp, Arabidopsis thaliana
  misc_feature (851)..(851): n is a, c, g, or t
cctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatctncattatgtttgtaaaactgagaaacgagtgtaaattaaattgattcagtttcagtat

SEQ ID NO: 2243 - protein, 216 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 2244 - DNA, 632 bp, Brassica napus
cacccgatataccggggagttcgtctgagaaagtcaggtaagtgggtgtgtgaagtgagggaaccaaacaagaaatctagaatttggcttggaactttcaaaacagctgagatggcagctcgtgctcacgacgtcgctgccctagccctccgtggaagaggcgcctgcctcaattatgcggactcggcttggcggctccgcatcccggagacaacctgccacaaggatatccagaaggctgctgctgaagccgcattggcttttgaggctgagaaaagtgatgtgacgatgcaaaatggccagaacatggaggagacgacggcggtggcttctcaggctgaagtgaatgacacgacgacagaacatggcatgaacatggaggaggcaacggcagtggcttctcaggctgaggtgaatgacacgacgacggatcatggcgtagacatggaggagacaatggtggaggctgtttttactggggaacaaagtgaagggtttaacatggcgaaggagtcgacggtggaggctgctgttgttacggaggaaccgagcaaaggatcttacatggacgaggagtggatgctcgagatgccgaccttgttggctgatatggcagaagggatgctcctgcc

SEQ ID NO: 2245 - protein, 208 aa, Brassica napus
HPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETTAVASQAEVNDTTTEHGMNMEEATAVASQAEVNDTTTDHGVDMEETMVEAVFTGEQSEGFNMAKESTVEAAVVTEEPSKGSYMDEEWMLEMPTLLADMAEGM

SEQ ID NO: 2246 - DNA, 20 bp, artificial sequence
  Artificial Sequence
  misc_feature (3)..(18): y = c or t;  n = a, c g or t;  h = a, c or t;  m = a or c
cayccnathtaymgnggngt

SEQ ID NO: 2247 - DNA, 21 bp, artificial sequence
  Artificial Sequence
  misc_feature (3)..(18): y = c or t;  n = a, c g or t;  h = a, c or t;  m = a or c; r = a or g
  misc_feature (3)..(18): y = c or t;  n = a, c g or t;  h = a, c or t;  m = a or c;  r = a or g
ggnarnarcatnccytcngcc
